United States Patent 12,622,926 (IMMUNOTHERAPY TARGETING TUMOR NEOANTIGENIC PEPTIDES) - sequence listing, part 2

SEQ ID NO: 3353 - DNA, 976 bp, Artificial Sequence
  Synthetic polypeptide
atgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaagagatgacacccactctgacagggccgagggaagaaccataagcgatggcaatgcaacagagtggcacatgacaagagctcagcgaat

SEQ ID NO: 3354 - DNA, 857 bp, Artificial Sequence; identical to SEQ ID NO: 1374
  Synthetic polypeptide

SEQ ID NO: 3355 - DNA, 836 bp, Artificial Sequence
  Synthetic polypeptide
atgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagctggaaaccaccattctcagcaaactatcgcaaggacaaaaaaccaaacaccgcatgttctcactcataggtgggagttgaacaatgagaacacatggacacaggaaggggaacatcacacaccggggactgttgtggggtggggggaggggggagggata

SEQ ID NO: 3356 - DNA, 839 bp, Artificial Sequence
  Synthetic polypeptide
atgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagcagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagctggaaaccaccattctcagcaaactatcgcaaggacaaaaaaccaaacaccgcatgttctcactcataggtgggagttgaacaatgagaacacatggacacaggaaggggaacatcacacaccggggactgttgtggggtggggggaggggggagggata

SEQ ID NO: 3357 - DNA, 938 bp, Artificial Sequence; identical to SEQ ID NO: 2101
  Synthetic polypeptide

SEQ ID NO: 3358 - DNA, 2394 bp, Artificial Sequence
  Synthetic polypeptide
atggacggtgccatggggcctcgggggctgctgttgtgcatgtacctggtatctctcctcatcctgcaggccatgcctgccctgggctcggctacaggcaggtccaagagcagcgagaagcgacaggctgtggacaccgctgtcgatggcgtgttcatccggagtttgaaagtcaactgcaaagtcacctctcgcttcgcccactatgttgtcaccagccaagtggtcaacactgccaatgaagccagggaagtggccttcgacctggaaatccccaagacagcattcatcagtgactttgccgttacagcagatggaaacgcatttatcggagacataaaggacaaggtgactgcatggaagcagtaccggaaagcagctatctcaggagagaatgccggccttgtcagggcctcggggagaactatggagcaattcaccatccacctcaccgtcaatccccagagcaaggtcacgtttcagctgacttatgaggaagtgctgaagagaaaccatatgcagtatgaaattgtcatcaaagtcaagcccaagcagctggtgcatcattttgagattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcagtcgagacaagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacgggctcggagtgaggattgaatgatgcagtttgcacagagggcttagcacaggacctggcacattgcaagggccc

SEQ ID NO: 3359 - DNA, 1968 bp, Artificial Sequence
  Synthetic polypeptide
atggagcaattcaccatccacctcaccgtcaatccccagagcaaggtcacgtttcagctgacttatgaggaagtgctgaagagaaaccatatgcagtatgaaattgtcatcaaagtcaagcccaagcagctggtgcatcattttgagattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcagtcgagacaagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacgggctcggagtgaggattgaatgatgcagtttgcacagagggcttagcacaggacctggcacattgcaagggccc

SEQ ID NO: 3360 - DNA, 1530 bp, Artificial Sequence
  Synthetic polypeptide
atgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacgggctcggagtgaggattgaatgatgcagtttgcacagagggcttagcacaggacctggcacattgcaagggccc

SEQ ID NO: 3361 - DNA, 1053 bp, Artificial Sequence
  Synthetic polypeptide
tccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagagggtataggctgcagggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacgggctcggagtgaggattgaatgatgcagtttgcacagagggcttagcacaggacctggcacattgcaagggccc

SEQ ID NO: 3362 - DNA, 492 bp, Artificial Sequence
  Synthetic polypeptide
atgccactccccctcccatcagcgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacgggctcggagtgaggattgaatgatgcagtttgcacagagggcttagcacaggacctggcacattgcaagggccc

SEQ ID NO: 3363 - DNA, 750 bp, Artificial Sequence
  Synthetic polypeptide
atgccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaaggaaatgcttcatgggaaaccc

SEQ ID NO: 3364 - DNA, 732 bp, Artificial Sequence
  Synthetic polypeptide
atgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaaggaaatgcttcatgggaaaccc

SEQ ID NO: 3365 - DNA, 1393 bp, Artificial Sequence
  Synthetic polypeptide
atgatccagttgacagctacccctgtgagtgcacttgttgatgagccagtgcatatccgagctacaggcctgattccctttcagatggtgagttttcaggcatcactggaagatgaaaacggagacatgttttattctcaagcccactatagggccaatgaattcggtgaggtggacctgaatcatgcttcttcacttggaggggattatatgggagtccaccccatgggtctcttctggtctctgaaacctgaaaagctattaacaagactgttgaaaagagatgtgatgaataggcctttccaggtccaagtaaaactttatgacttagagttaatagtgaacaataaagttgccagtgctccaaaggccagcctgactttggagaggtggtatgtggcacctggtgtcacacgaattaaggttcgagaaggccgccttcgaggagctctctttctccctccaggcacagactgccaaggctgggggcaacatatctgtatcaaaagaggaagcttggaaaccggtaggaccttgacgccaggtggcctcaaatctccacttcctgcattctgctgcaatgctcctcacctgccccaggtatggttcacgcaggcccatgtgcagtttgggccactctctggaaggcaatatagtaaatcttggtggtgtctgtgcagtgctatctctaccaaagtgcagagtgcacaagtcatgagggcatgcctgcctccacttagatttcaaaggatgccccagaaagcctcagagcccagacagagaactatcacaggagcaggaccaccacagacagcccccaccccagtatggcaatgcccagtgaaaccgtgggagcagagccacccccaagaccccagactggtagagccaccagtgtgcaattccagcctgggagagccataggcatgtgactccaatatgtgagaaatgctatatgggttttgcccagcaaagtcatggccaggactaccccccaccccccaagtgtttagaaggtaaaatgtcaagtcgaagattattcttgagccttaatatttgccctgttgggttttacagttagtcaggatttattatctttttcttccttcctacttctaccttttggaaaggaaatgtctgccctgtgcctatcccaccattgtattttcaaagcatgtaacttgtttgatttcagaggctcacagctgaaggggaatttgcctcaggatgagtcacacctttgagtctcagtcatatttgatttaaatgagactttggacctcagacttttgaattggtgctggaacaagttaaggcctggggagctactgggatggaatgaatacattctgcatgtgagaagaacatacatttcggacggccagaagcagaa

SEQ ID NO: 3366 - DNA, 584 bp, Artificial Sequence
  Synthetic polypeptide
atgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagggacatggatgaagctggaaaccaccattctcagcaaactatcgcaaggacaaaaaaccaaacaccgcatgttctcactcataggtgggagttgaacaatgagaacacatggacacaggaaggggaacatcacacaccggggactgttgtggggtggggggaggggggagggata

SEQ ID NO: 3367 - DNA, 2161 bp, Artificial Sequence; identical to SEQ ID NO: 288
  Synthetic polypeptide

SEQ ID NO: 3368 - DNA, 2140 bp, Artificial Sequence; identical to SEQ ID NO: 289
  Synthetic polypeptide

SEQ ID NO: 3369 - DNA, 529 bp, Artificial Sequence; identical to SEQ ID NO: 287
  Synthetic polypeptide

SEQ ID NO: 3370 - DNA, 1260 bp, Artificial Sequence
  Synthetic polypeptide
atgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtggctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctctattacgtggcagagagttttaatgatgccaaggagaaagtaagcccctggaacaatacctgacacagagtaagcactcaataaataattggtgaaggcattaat

SEQ ID NO: 3371 - DNA, 1245 bp, Artificial Sequence
  Synthetic polypeptide
atgtcagccctaaccccaaccttggttttctgtcacatgcatgtagaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtggctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctctattacgtggcagagagttttaatgatgccaaggagaaagtaagcccctggaacaatacctgacacagagtaagcactcaataaataattggtgaaggcattaat

SEQ ID NO: 3372 - DNA, 559 bp, Artificial Sequence; identical to SEQ ID NO: 1701
  Synthetic polypeptide

SEQ ID NO: 3373 - DNA, 1638 bp, Artificial Sequence
  Synthetic polypeptide
atggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagaaaaatactgaagaatgttcttcattcaaatgcctgaaaccttgttagagaaagtcctgagctccagcaatcaggaaacctcgtgtaggagaatgagagtgtcagggaggctgcctagcaccagacctagaaaacaactacttcagaacagacctgggggataattcagaagtgagatgagacagcaagaacaaaagagatgtgacagattttatgagagtttccaataactaaaaaggagtttcaaacatctgctggaacatttgtaaataattctaacttgggaaatggaaaattacaaattgaaataaagagacattgttaagcccaggaaagtacaaaaataaaatttaatcatagttgtcttaccagagaaccatatttgtgtagtcagaatgatgtaagcaatgaatactgatatcataaaaattgtcatctaaatatattctggaaaaagcagtgtggaaaagtgagtgtgtctatctgagggtgtgttcaaatatgaggggaagatggagattaaaattctcatctctcttaataaaaaattattaaatataatctacaaaaagataagtaagaattagaaacagagtatttaaaaatgtgaatgtatgttcagaagaagctgctagaatgttcaaaatggtagatttggaaagtgtgagaatgaagag

SEQ ID NO: 3374 - DNA, 128 bp, Artificial Sequence; identical to SEQ ID NO: 144
  Synthetic polypeptide

SEQ ID NO: 3375 - DNA, 1014 bp, Artificial Sequence
  Synthetic polypeptide
atgatccagttgacagctacccctgtgagtgcacttgttgatgagccagtgcatatccgagctacaggcctgattccctttcagatggcacagactgccaaggctgggggcaacatatctgtatcaaaagaggaagcttggaaaccggtaggaccttgacgccaggtggcctcaaatctccacttcctgcattctgctgcaatgctcctcacctgccccaggtatggttcacgcaggcccatgtgcagtttgggccactctctggaaggcaatatagtaaatcttggtggtgtctgtgcagtgctatctctaccaaagtgcagagtgcacaagtcatgagggcatgcctgcctccacttagatttcaaaggatgccccagaaagcctcagagcccagacagagaactatcacaggagcaggaccaccacagacagcccccaccccagtatggcaatgcccagtgaaaccgtgggagcagagccacccccaagaccccagactggtagagccaccagtgtgcaattccagcctgggagagccataggcatgtgactccaatatgtgagaaatgctatatgggttttgcccagcaaagtcatggccaggactaccccccaccccccaagtgtttagaaggtaaaatgtcaagtcgaagattattcttgagccttaatatttgccctgttgggttttacagttagtcaggatttattatctttttcttccttcctacttctaccttttggaaaggaaatgtctgccctgtgcctatcccaccattgtattttcaaagcatgtaacttgtttgatttcagaggctcacagctgaaggggaatttgcctcaggatgagtcacacctttgagtctcagtcatatttgatttaaatgagactttggacctcagacttttgaattggtgctggaacaagttaaggcctggggagctactgggatggaatgaatacattctgcatgtgagaagaacatacatttcggacggccagaagcagaa

SEQ ID NO: 3376 - DNA, 609 bp, Artificial Sequence; identical to SEQ ID NO: 249
  Synthetic polypeptide

SEQ ID NO: 3377 - DNA, 738 bp, Artificial Sequence; identical to SEQ ID NO: 250
  Synthetic polypeptide

SEQ ID NO: 3378 - DNA, 537 bp, Artificial Sequence; identical to SEQ ID NO: 251
  Synthetic polypeptide

SEQ ID NO: 3379 - DNA, 684 bp, Artificial Sequence; identical to SEQ ID NO: 253
  Synthetic polypeptide

SEQ ID NO: 3380 - DNA, 285 bp, Artificial Sequence; identical to SEQ ID NO: 255
  Synthetic polypeptide

SEQ ID NO: 3381 - DNA, 552 bp, Artificial Sequence; identical to SEQ ID NO: 254
  Synthetic polypeptide

SEQ ID NO: 3382 - DNA, 1094 bp, Artificial Sequence; identical to SEQ ID NO: 153
  Synthetic polypeptide

SEQ ID NO: 3383 - DNA, 451 bp, Artificial Sequence; identical to SEQ ID NO: 339
  Synthetic polypeptide

SEQ ID NO: 3384 - DNA, 2217 bp, Artificial Sequence
  Synthetic polypeptide
atggaccaaaatcaacatttgaataaaacagcagaggcacaaccttcagagaataagaaaacaagatactgcaatggattgaagatgttcttggcagctctgtcactcagctttattgctaagacactaggtgcaattattatgaaaagttccatcattcatatagaacggagatttgagatatcctcttctcttgttggttttattgacggaagctttgaaattggaaatttgcttgtgattgtatttgtgagttactttggatccaaactacatagaccaaagttaattggaatcggttgtttcattatgggaattggaggtgttttgactgctttgccacatttcttcatgggatattacaggtattctaaagaaactaatatcaattcatcagaaaattcaacatcgaccttatccacttgtttaattaatcaaattttatcactcaatagagcatcacctgagatagtgggaaaaggttgtttaaaggaatctgggtcatacatgtggatatatgtgttcatgggtaatatgcttcgtggaataggggagactcccatagtaccattggggctttcttacattgatgatttcgctaaagaaggacattcttctttgtatttaggtatattgaatgcaatagcaatgattggtccaatcattggctttaccctgggatctctgttttctaaaatgtacgtggatattggatatgtagatctaagcactatcaggataactcctactgattctcgatgggttggagcttggtggcttaatttccttgtgtctggactattctccattatttcttccataccattctttttcttgccccaaactccaaataaaccacaaaaagaaagaaaagcttcactgtctttgcatgtgctggaaacaaatgatgaaaaggatcaaacagctaatttgaccaatcaaggaaaaaatattaccaaaaatgtgactggttttttccagtcttttaaaagcatccttactaatcccctgtatgttatgtttgtgcttttgacgttgttacaagtaagcagctatattggtgcttttacttatgtcttcaaatacgtagagcaacagtatggtcagccttcatctaaggctaacatcttattgggagtcataaccatacctatttttgcaagtggaatgtttttaggaggatatatcattaaaaaattcaaactgaacaccgttggaattgccaaattctcatgttttactgctgtgatgtcattgtccttttacctattatattttttcatactctgtgaaaacaaatcagttgccggactaaccatgacctatgatggaaataatccagtgacatctcatagagatgtaccactttcttattgcaactcagactgcaattgtgatgaaagtcaatgggaaccagtctgtggaaacaatggaataacttacatctcaccctgtctagcaggttgcaaatcttcaagtggcaataaaaagcctatagtgttttacaactgcagttgtttggaagtaactggtctccagaacagaaattactcagcccatttgggtgaatgcccaagagatgatgcttgtacaaggaaattttacttttttgttgcaatacaagtcttgaatttatttttctctgcacttggaggcacctcacatgtcatgctgattgttaaaattgttcaacctgaattgaaatcacttgcactgggtttccactcaatggttatacgagcactaggaggaattctagctccaatatattttggggctctgattgatacaacgtgtataaagtggtccaccaacaactgtggcacacgtgggtcatgtaggacatataattccacatcattttcctcagattccagttcagaaatgagcattctcttcaccatcgcacactcagcaaaatctgattcccctgaaaccttctcatgcagtggctgtttactttttcttgctgctctgtgaatataggtaagtctcttctccttgttttagtttccaggccattctcctcacttcctcccaccacaaaggaagtggctccaaatttcatgtcatcagatcttaatacgatatctcactgctgcagtcatacctacatcaaagttaaactccccctttccaatgattttagttcctctctcttgtttcaaagccagtcttggtttgaaccttggttattttttatatgcccagagttga

SEQ ID NO: 3385 - DNA, 877 bp, Artificial Sequence; identical to SEQ ID NO: 970
  Synthetic polypeptide

SEQ ID NO: 3386 - DNA, 763 bp, Artificial Sequence
  Synthetic polypeptide
ggcctttcaggacctcctagatcaagttggaggcctggggagattccagatccttcagatggttttccttataatgttcaacgtcatagtataccatcaaactcagctggagaacttcgcagcattcatacttgatcatcgctgctgggttcatatactggacaatgacactatccctgacaatgaccctgggaccctcagccaggatgccctcctgagaatctccatcccattcgactcaaatctgaggccagagaagtgtcgtcgctttgtccatccccagtggaagctcattcatctgaatgggaccttccccaacacgagtgagccagatacagagccctgtgtggatggctgggtatatgaccaaagctccttcccttccaccattgtgactaagtgggatctggtatgcgaatctcaaccactgaattcagtagctaaatttctattcatggctggaatgatggtgggaggcaacctatatggccatttgtcagacaggaaaccattatcatcgcccaaccatgtctccactgattgtgacgagggacttgaggtgcccattgccatccaccagcatcacgtcttctgaaaaaggaatgaagaacttactctgtaccataacatggatgaataccaaaatcattttgtttgccacaagaacaaccaaaaatgattgcacacgataccacttcacttatgtaaacgtcaaagaaaagcaacgatggtgttgggagtcagaaaggtgattctctttagg

SEQ ID NO: 3387 - DNA, 2166 bp, Artificial Sequence
  Synthetic polypeptide
atggagccgggcaggacccagataaagcttgaccccaggtacacagcagatcttctggaggtgctgaagaccaattacggcatcccctccgcctgcttctctcagcctcccacagcagcccaactcctgagagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtggtgtctgtgctgtgctgctttggtctctggatccctcgttccctggtgctggtggaaatgaccatcacctcgttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggaagaagcttcagctgctgatgttgggccctttccaatacgccttcttgaagataacgctgaccctggtgggcctgtttctcgtccccgacggcatctatgacccagcagacatttctgaggggagcacagctctatggatcaacactttccttggcgtgtccacactgctggctctctggaccctgggcatcatttcccgtcaagccaggctacacctgggtgagcagaacatgggagccaaatttgctctgttccagggttttgctgtgttggccgggctggtctccagctcctaaccgcgagtgatccgccagcctcggcctcccgaggtgccgggattgcagacggagtctcgttcactcagtgctcaatgctgcccaggctggagtgcagtggcgtgatctcggctcgctacaacctccacctcccagccgcctgccttggcctcccaaagtgctgagactgcagcctctgcccggccgccaccccgtctgggaagtgaggagcgtctctgcctggccgcccatcgtctgggatgtgaggagcccctctgcccggccgcccagtctgggaagtgaggagcgcctcttcccggccgcccatcgtctgagatgtggggagcgcctctgccccgccgccccatctgggatgtgaggagcgcctctgccaggccacgaccccgtctgggaactgaggagtgtctctgcccgaccgccacccagtcttggaggtgaggagcgcctctgcccggccacgaccccgtctgggatgtgaggagcgtctctgcctggccgcccatcgtctgggatgtgaggagcccctctgcccggctgcccagtctgggaagtgaggagcgcctcctccccgccgccatcccgtctaggaagtgaggagcgtctctgcccggccgcccatcgtctgagatgtggggagcgccactgccccgccgccccgtttgggatgtgaggagctcctctgcccggccgcgacccggtctgggaagtgaggagcgtctccgcccggcagccaccccgtccgggaggtgaggggcgcctctgcccggccgcccctactgggaggtgaggagcccctctgcccggccaccaccccgtctgggaggtgtacccaacagctcattgagaacgggccatgatgacgatggcggttttgtcgaatagaaaagggggaaatgtggggaaaagatagaaaaatcagattgttgctgtgtctgtgtagaaagaagtagacatgggagactcaattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcagaaggccgcagggccctctgcctaggaaaaccagagacctttgttcacttgtttatctgctgaccttccgtccactattgtcctatgaccctgccaaatccccctctgcgagaaacacccaagaatgatcaataaaaatacataaataaataaaagaa

SEQ ID NO: 3388 - DNA, 1443 bp, Artificial Sequence
  Synthetic polypeptide
caagccaggctacacctgggtgagcagaacatgggagccaaatttgctctgttccagggttttgctgtgttggccgggctggtctccagctcctaaccgcgagtgatccgccagcctcggcctcccgaggtgccgggattgcagacggagtctcgttcactcagtgctcaatgctgcccaggctggagtgcagtggcgtgatctcggctcgctacaacctccacctcccagccgcctgccttggcctcccaaagtgctgagactgcagcctctgcccggccgccaccccgtctgggaagtgaggagcgtctctgcctggccgcccatcgtctgggatgtgaggagcccctctgcccggccgcccagtctgggaagtgaggagcgcctcttcccggccgcccatcgtctgagatgtggggagcgcctctgccccgccgccccatctgggatgtgaggagcgcctctgccaggccacgaccccgtctgggaactgaggagtgtctctgcccgaccgccacccagtcttggaggtgaggagcgcctctgcccggccacgaccccgtctgggatgtgaggagcgtctctgcctggccgcccatcgtctgggatgtgaggagcccctctgcccggctgcccagtctgggaagtgaggagcgcctcctccccgccgccatcccgtctaggaagtgaggagcgtctctgcccggccgcccatcgtctgagatgtggggagcgccactgccccgccgccccgtttgggatgtgaggagctcctctgcccggccgcgacccggtctgggaagtgaggagcgtctccgcccggcagccaccccgtccgggaggtgaggggcgcctctgcccggccgcccctactgggaggtgaggagcccctctgcccggccaccaccccgtctgggaggtgtacccaacagctcattgagaacgggccatgatgacgatggcggttttgtcgaatagaaaagggggaaatgtggggaaaagatagaaaaatcagattgttgctgtgtctgtgtagaaagaagtagacatgggagactcaattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcagaaggccgcagggccctctgcctaggaaaaccagagacctttgttcacttgtttatctgctgaccttccgtccactattgtcctatgaccctgccaaatccccctctgcgagaaacacccaagaatgatcaataaaaatacataaataaataaaagaa

SEQ ID NO: 3389 - DNA, 770 bp, Artificial Sequence
  Synthetic polypeptide
atggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggctgataaagaatttgtatggtctttgtggaaacgtctccaggttacaaacccagatctcacacaagtggtcagtttggttgtggaaaggaggccaccggaagatgtgtaccaccaaaacgaagaatataccaaaaaagataaaaagttgggattgagaaaatgtgagatccaacacatgaataatataaagatattccaaggtgaagatgaaagaagattgagaagacttggtagcagtagttctcaatgaagcaggactacagcagttctttaagaaggatgactctgaaaaaattagcagtgatagattgtaatgtttttgagaaagatatttcatactttttgagaattttagaaaggattagtgataagtaaacagaaaactgcacaaataaaagtgacataatt

SEQ ID NO: 3390 - DNA, 1041 bp, Artificial Sequence; identical to SEQ ID NO: 969
  Synthetic polypeptide

SEQ ID NO: 3391 - DNA, 1339 bp, Artificial Sequence
  Synthetic polypeptide
atggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaaaaaaagtttgccagctcctg

SEQ ID NO: 3392 - DNA, 1603 bp, Artificial Sequence
  Synthetic polypeptide
atggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaaaaaaagtttgccagctcctg

SEQ ID NO: 3393 - DNA, 1519 bp, Artificial Sequence
  Synthetic polypeptide
atggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaagggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaaaaaaagtttgccagctcctg

SEQ ID NO: 3394 - DNA, 1642 bp, Artificial Sequence
  Synthetic polypeptide
atggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgaggtaaatcagggatttcttcttgatttggatccattgttgcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaaaaaaagtttgccagctcctg

SEQ ID NO: 3395 - DNA, 916 bp, Artificial Sequence; identical to SEQ ID NO: 1226
  Synthetic polypeptide

SEQ ID NO: 3396 - DNA, 491 bp, Artificial Sequence
  Synthetic polypeptide
atgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttgggattatgagagcgcctccttcagaggtcgctaggaggcttctgcgtgaagacggacagcaatggctgaggtgcggaaagtgctcgat

SEQ ID NO: 3397 - DNA, 518 bp, Artificial Sequence
  Synthetic polypeptide
atgttgttactcttccactccaaaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttgggattatgagagcgcctccttcagaggtcgctaggaggcttctgcgtgaagacggacagcaatggctgaggtgcggaaagtgctcgat

SEQ ID NO: 3398 - DNA, 1629 bp, Artificial Sequence; identical to SEQ ID NO: 2518
  Synthetic polypeptide

SEQ ID NO: 3399 - DNA, 256 bp, Artificial Sequence
  Synthetic polypeptide
atgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtggcccagcaggccaggtttgccgtgagattgaaatgagagagcgttcgaaccgtttggcacagcacctgcacgtaaagatgcttgatcaatg

SEQ ID NO: 3400 - DNA, 310 bp, Artificial Sequence
  Synthetic polypeptide
atggggacctggggtgcccctcacaggacacttccttgcaggaacagaggtgccatgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtggcccagcaggccaggtttgccgtgagattgaaatgagagagcgttcgaaccgtttggcacagcacctgcacgtaaagatgcttgatcaatg

SEQ ID NO: 3401 - DNA, 203 bp, Artificial Sequence
  Synthetic polypeptide
atgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacaaaaagtttgccgactcccg

SEQ ID NO: 3402 - DNA, 1675 bp, Artificial Sequence
  Synthetic polypeptide
atgctaaggaggttggacaaaatcaggttcagaggtcacaagagagatgacttcctcgatctagcggagtctccaaatgcctcggacaccgaatgcagcgacgaaatccccctgaaggtaccgcggacctcgccccgggacagcgaggagctgagggaccctgctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggtttggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaagtaaatcatcatcataggagtgtggaagctgctggtacaaaat

SEQ ID NO: 3403 - DNA, 244 bp, Artificial Sequence
  Synthetic polypeptide
atgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaagtaaatcatcatcataggagtgtggaagctgctggtacaaaat

SEQ ID NO: 3404 - DNA, 1477 bp, Artificial Sequence
  Synthetic polypeptide
atgcttcctgctgtggctgtctcggaacccgtggtcctccgcttcattctgccgagttcctgggattgcaggtgcgcgccgccactcctgactggtttttgtattttttggtggagacggggtttcaccgtgttggccgggctggtctccagctcctgaccgcgagtgatctgccagcctcggcgtcctgaggtgccgggattgcagacggagtctcgctcactcagtgctcaatgttgcccatgctggagtgcagtggcgtgatcttggctcgctacaacctccacctcccagccgcctgccttggcctcccaaagtgccgagattgcagcctctgcccggccgccaccccgtctaggaagtgaggagcgtctttgcctggccgcccatcgtcggggatgtgaggagcccctctgcccggccgcccagtctgggaagtgaggagcacctcttcccggccgtcatcctgtctaggaagtgaggagcgtctctgcccagccgcccatcatctgggatgtggggagcatctctgccccgtcgccccgtctgagatgtgaagagcgcctctgcccggccgcgaccctgtctgggaactgaggagtgtctctgccccgccgccaccccgtctgggaggtgaggagcgtctctgaccggctgcccggtctgagaagtgaggagcccctccgcccggcagccgccccgtctgggaagtgaggagcgtttccgctttccgcccggcagcggccccgtccgggaggtggggggcagcccccgcccggccggcgccccgtctgggaggtggagggcgcctctgcccggccgccccatctgggaagtgaggagcccctctgcccggccgccaccccgtctgggaggtgtacccaacagctcattgagaacgggccatgatgacgatggcagttttgtcgaatagaaaagggggaaatgtggggaaaagaaagagagatcagattgttactgtgtctgtgtggaaagaagtagacataggagactccattttgttctgtactaagaaaaattcttctgccttgggatgctgttaatctataaccttacccccaaccccgtgctctctgaaacatgtgctgtgtccactaagggttaaatggcccctgctctctgaaacatgtgctgtgtccgctaagggttaaatggcccgtgctctctgaaacgtgctgtgtccactaagggttaaatggattaagggcggtgcaagatgtgctttgttaaacagatgcttgaaggcagcatgctccttaagagttatcaccactccctaatctcaagtacccagggacaaacactgcagaaggcggcagggccctctgcctaggaaaaccagagacctttgttcatatgtttatctgctgaccttccctccactattgtcctatgaccctcccaaatccccctctccaagaaacacccaagaatgatcaataaatactaaaaaaaa

SEQ ID NO: 3405 - DNA, 687 bp, Artificial Sequence
  Synthetic polypeptide
atgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagtg

SEQ ID NO: 3406 - DNA, 360 bp, Artificial Sequence
  Synthetic polypeptide
cacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagtg

SEQ ID NO: 3407 - DNA, 811 bp, Artificial Sequence
  Synthetic polypeptide
atgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgaggctaggtgcagtggctcacacttgtaatcccagctgtttgggaggccaaggcgggaggatcgcttgagcccaagagtccaagaccagcctgggcaacacagccagaccctgtctctacaaaaaagaaaagttaaaaacaaacaaaaaaacagctgtgtgtggtggtgcttgcttgtggttgcagctaccccaggaggctgaggcaggaggatcacttgagcccaggaattccaggctgcagtgagccgtgatcgcaccactgcactccagcctgggtggcagagtgagaccctgtctcaaaaaataa

SEQ ID NO: 3408 - DNA, 691 bp, Artificial Sequence
  Synthetic polypeptide
atgacgacttacagtgacaaaggggcaaagcctgagagaggccgattcctccacttccactctgtgaccttctgggttggcaacgccaagcaggccacgtcattctactgcagcaagatgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgcactttgtgaggccgaggcaggtggatcacctgagttcaggagttcgagaccagcctggccaacgtggcaaaaccctgtctttactaaatatacaaaaattagctgggcatgacaggcgcctgtaatcccagctactcgggaggctgaggcagaagaatcacttgaacccgggagacagaggttgcagtgagccaaggttgcaccactgtactccagcctgggcgacagagcgagactccatctcaaataaataaataaaaattttaaaaaataaaa

SEQ ID NO: 3409 - DNA, 574 bp, Artificial Sequence
  Synthetic polypeptide
atgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgcactttgtgaggccgaggcaggtggatcacctgagttcaggagttcgagaccagcctggccaacgtggcaaaaccctgtctttactaaatatacaaaaattagctgggcatgacaggcgcctgtaatcccagctactcgggaggctgaggcagaagaatcacttgaacccgggagacagaggttgcagtgagccaaggttgcaccactgtactccagcctgggcgacagagcgagactccatctcaaataaataaataaaaattttaaaaaataaaa

SEQ ID NO: 3410 - DNA, 115 bp, Artificial Sequence
  Synthetic polypeptide
atgaggctcttcctgtcgctcccggtcctggtggtggttctgtcgatcgtcttggaaggcggaggttgcagtaagccgagatcgcaccatttgacacagcaagtctccgtctcaa

SEQ ID NO: 3411 - DNA, 197 bp, Artificial Sequence
  Synthetic polypeptide
atggatccagctgtggctctggtgctctgtctctcctgtttgtttctcctttcactctggaggcagagctctggaagagggaggctcccgtctggccccactcctctcccgattattggaaatatcctgcagttagatgttaaggacatgagcaaatccttaaccaatgctccaaccaagtacagtgaaactggaat

SEQ ID NO: 3412 - DNA, 148 bp, Artificial Sequence
  Synthetic polypeptide
atgctgcctaagagaagcaggccgagcacggtggctcacacctctaatcccagcactttggaaggctgagacaagaggattgttgaggtcaggaattcaagaccagcctggtcaacagagtgagatgtcctctctaggaaaagaagaa

SEQ ID NO: 3413 - DNA, 496 bp, Artificial Sequence
  Synthetic polypeptide
atggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagccaggtgcgatggttcacacctgtaatcccagcactttgggaggccgaggtaggcacttgaagtcaggagttcgagaccagcctggccaacgtggtgaaacctcatctctactaaaaatacaaaaaaaattagccaagcatggtgacgcacgcctgtaatcacagctaattaggaggctgaggcaggcaaatttcttgaacctgggaggtggacgttgcagtgatctgagattgtgccactgcactctagcctgggcgacacagtgagactgtctcaaaaacaaagaaaaaaaa

SEQ ID NO: 3414 - DNA, 312 bp, Artificial Sequence; identical to SEQ ID NO: 2525
  Synthetic polypeptide

SEQ ID NO: 3415 - DNA, 998 bp, Artificial Sequence
  Synthetic polypeptide
atgatcccgctgctgctggcagcgctgctgtgcgtccccgccggggccctgacctgctacggggactccgggcagcctgtagactggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccagctcgccttcctgctctacaatgaccaaccgcctcaacccagcaaggctcaggactcttccatgcgtgggcacacgaagggtgtcctgctccttgaccacgatgggggcttctggctggtccacagtgtacctaacttccctccaccggcctcctctgctgcatacagctggcctcatagcgcctgtacctacgggcagaccctgctctgtgtgtcttttcccttcgctcagttctcgaagatgggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatgacctgtactccggctggttggcagcagcccttggtaccaacctgcaggtccagttctggcacaaaactgtaggcatcctgccctctaactgctcggatatctggcaggttctgaatgtgaaccagatagctttccctggaccagccggcccaagcttcaacagcacagaggaccactccaaatgctgtatgaccttgattgtgtgccttaaccgctctgtgacacagtctacctgtctgcaaaatgggaaacataatacctgccatcaggattgttgaggagtaaataa

SEQ ID NO: 3416 - DNA, 833 bp, Artificial Sequence
  Synthetic polypeptide
atgatcccgctgctgctggcagcgctgctgtgcgtccccgccggggccctgacctgctacggggactccgggcagcctgtagactggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccagctcgccttcctgctctacaatgaccaaccgcctcaacccagcaaggctcaggactcttccatgcgtgggcacacgaagggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatgacctgtactccggctggttggcagcagcccttggtaccaacctgcaggtccagttctggcacaaaactgtaggcatcctgccctctaactgctcggatatctggcaggttctgaatgtgaaccagatagctttccctggaccagccggcccaagcttcaacagcacagaggaccactccaaatgctgtatgaccttgattgtgtgccttaaccgctctgtgacacagtctacctgtctgcaaaatgggaaacataatacctgccatcaggattgttgaggagtaaataa

SEQ ID NO: 3417 - DNA, 2227 bp, Artificial Sequence
  Synthetic polypeptide
cagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaagagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtgggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccg

SEQ ID NO: 3418 - DNA, 2740 bp, Artificial Sequence
  Synthetic polypeptide
atgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctcccccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtgggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccg

SEQ ID NO: 3419 - DNA, 2701 bp, Artificial Sequence
  Synthetic polypeptide
atgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctcccccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacaggtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtgggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccg

SEQ ID NO: 3420 - DNA, 1352 bp, Artificial Sequence; identical to SEQ ID NO: 1101
  Synthetic polypeptide

SEQ ID NO: 3421 - DNA, 1589 bp, Artificial Sequence; identical to SEQ ID NO: 1102
  Synthetic polypeptide

SEQ ID NO: 3422 - DNA, 506 bp, Artificial Sequence; identical to SEQ ID NO: 1096
  Synthetic polypeptide

SEQ ID NO: 3423 - DNA, 1335 bp, Artificial Sequence
  Synthetic polypeptide
atggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaaagaacttctgttcaca

SEQ ID NO: 3424 - DNA, 1599 bp, Artificial Sequence
  Synthetic polypeptide
atggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaaagaacttctgttcaca

SEQ ID NO: 3425 - DNA, 1515 bp, Artificial Sequence
  Synthetic polypeptide
atggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaagggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaaagaacttctgttcaca

SEQ ID NO: 3426 - DNA, 1638 bp, Artificial Sequence
  Synthetic polypeptide
atggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgaggtaaatcagggatttcttcttgatttggatccattgttgcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaaagaacttctgttcaca

SEQ ID NO: 3427 - DNA, 297 bp, Artificial Sequence
  Synthetic polypeptide
atgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgcactatgggaggctgagatgggaggattgcttgagcccaggagttcgagaccagcctgaccaacatggcgagatcctgtctccatttaaaaaaaaaaaaaaaa

SEQ ID NO: 3428 - DNA, 2797 bp, Artificial Sequence
  Synthetic polypeptide
atgtttcagactaagctacgaaatgaaacttgggaagacttgccaaaaatgtcctgcacaactgagatccaagcagcattcattctctcttcctttgtgaccttcttcagtggactcatcatcctgttgatcttcaggctgatctggagatctgttaaaaaatggcaaatcatcaagggaacaggaattatcttggaactgttcacatcaggtaccatcgctaggagccatgtaagaagcctccacttccagggacaatttcgtgatcatatagaaatgttgctttcagcccagacctttgtggggcaagtgttggtgatccttgtctttgtactaagcattgggtctcttataatctatttcatcaattctgctgaccctgttggaagctgttcatcatatgaagacaaaaccattcctattgatttggttttcaatgctttctttagtttctattttggattgaggtttatggcagctgatgacaagatcaagttctggctggagatgaattcaatcgtagacatctttaccatcccaccaacctttatttcttattatttgaagagcaattggctaggtttaaggttcctaagagccttgcgcctgctagaactccctcaaatcttgcaaattctacgagccatcaagaccagtaactcagtgaagttttccaaactgctgtcaataattctcagtacctggttcacagctgcgggattcattcacctggtggaaaattctggtgatccctggctcaaaggtagaaattcacagaatatatcatattttgagtcaatttacctggtcatggcaacaacgtcaaccgttggatttggagatgtggtagccaagacatccttaggacggaccttcatcatgttcttcacactggggagtttgatattatttgcgaactatatacctgaaatggtggaactgtttgctaacaagaggaaatacaccagttcctatgaagcactcaaaggaaagaagtttattgtggtctgtggaaacatcactgtggacagtgtgaccgctttcctgaggaatttcctccgcgacaagtcaggagagatcaacactgaaattgttttcctgggagaaacccctccttctttggaacttgaaaccatatttaaatgctacttggcctacacaacgttcatttctggatctgcaatgaagtgggaggatctgaggcgagttgcggtggaatctgcagaggcatgcctgattatagccaatcctttgtgcagtgattcccatgctgaagatatttccaacattatgagggtgctctctatcaagaactatgattctaccaccagaatcatcatacagatactgcaatcccataacaaggtttatctgccaaagattcccagctggaactgggacaccggagacaacatcatctgctttgctgaattaaaacttggatttatcgcccaaggctgtttggtgccaggcttgtgtaccttcctaacatctctatttgtggagcaaaacaaaaaggttatgcctaaacagacctggaagaaacacttcttgaatagcatgaaaaacaaaattctgacccaacgtctctctgatgactttgctggaatgagctttcctgaagttgcccggctctgctttctgaagatgcacctcctgttgatagccatcgaatacaagtccctctttacggatggtttctgtggtctgatactaaatccacctccacaagtgaggatacgtaagaacacattagggttctttattgctgaaactccaaaggacgtcagaagagccttgttttactgttcagtctgtcatgatgatgtgttcattcctgagctaattacaaactgtggctgcaaaagcagaagccggcagcacatcacagtgccatcggtaaagagaatgaaaaaatgtctgaagggaatctcctctcgtatatcagggcaggattctccgccaagggtatctgcaagcacttcgagcatatcaaacttcaccaccaggactcttcaacatgatgtagaacaagattctgaccagcttgatagcagtgggatgtttcactggtgcaaaccaacctctttggacaaggtgactctgaaacgaactggcaagtcaaagtataagtttcggaaccatattgtagcatgtgtatttggagatgcccactcagccccgatggggcttcggaactttgtaatgcccttgagagccagcaactataccaggaaggagctgaaggacatagtgttcattgggtctctggactatctacagagagaatggcgatttctctggaattttccccagatatacattctgcctggatgtgcactttattctggagacctccatgcggccaacatagagcaatgctccatgtgtgctgtcttgtcccccccaccccagccatcaagcaaccagactttggtagacacagaagccatcatggcaaccctcaccatcggatccttgcaaattgactcctcctctgacccgtcaccctcagtgtcagaggagactccaggttacacaaatggacataatgagaaatcaaactgccgaaaagtccctatccttactgaactgaaaaatccttccaacattcactttattgaacagcttggtggactggaagggtccctccaagaaacaaatctgcatctcagcactgccttttctacgggcactgttttttccggcagcttcttggattctctgctggccacggagatctgggatcccagaaatctacactcattaatatcacttcagatgatccagatacatg

SEQ ID NO: 3429 - DNA, 277 bp, Artificial Sequence; identical to SEQ ID NO: 1903
  Synthetic polypeptide

SEQ ID NO: 3430 - DNA, 1162 bp, Artificial Sequence
  Synthetic polypeptide
atgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggaaatgtgaacagagagagaatgccgtgagatgatggagggatagattggaatgatgtctgcgagctaaggaatactgaggattgctgccaaccatccgaagctgggagaggagatggaacaactccctcggagcctccaagaggaaccaaccccactgatgctttgatttgggatttccggcctgaactgtaggaaaataaatttctgttcttttaagccatttttaccagtttgtggtaacttgttacagcagctgcaggaaattaata

SEQ ID NO: 3431 - DNA, 865 bp, Artificial Sequence
  Synthetic polypeptide
atgccacagtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggaaatgtgaacagagagagaatgccgtgagatgatggagggatagattggaatgatgtctgcgagctaaggaatactgaggattgctgccaaccatccgaagctgggagaggagatggaacaactccctcggagcctccaagaggaaccaaccccactgatgctttgatttgggatttccggcctgaactgtaggaaaataaatttctgttcttttaagccatttttaccagtttgtggtaacttgttacagcagctgcaggaaattaata

SEQ ID NO: 3432 - DNA, 1889 bp, Artificial Sequence
  Synthetic polypeptide
atgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaaatggagtcccactctgttgcccaggctggagtacagtggcatgatcttggctcactgcaacctccacctcccagatgtcaagcgattctcttgcctcagcctcccaagtagctggggttacaggcatgtgccaccatgctgagaaacctgaacggactccatttggctccttcatttgcaagacatcaagggctccttacccacccccttcctcaaggaattaacttgtgcaagctgactcccagcacatcaaagaatgcaattaactgataacatgctgtggcaagctatgtccgcagttcccaggaatttgtccagttgatattaccctaagcccctgtgtttttgtctggttgatagcacccaaagcccagcgtctatcaccttgtgatggatttaaagcccctgcacctggaactgtttgctttcctgtaaccatttgtctttttaacttcttttgcctgttttacttctgtaagactgctacagctaggctccccctcccctctctaaaccaaagtataaaacaaaatctagccccttcttcagggccgagagaattttgagcactagccgtctctcggtcgctggctaataaaggactcctcaattcgtctcagagtgtggcgtttctgtataactcgctcggttacaaca

SEQ ID NO: 3433 - DNA, 1357 bp, Artificial Sequence
  Synthetic polypeptide
atgggccgaggggtgcgcgtgctgctgctgctgagcctgctgcactgcgccgggggcagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagctgggcgtggtggcgggtgcctgtaatccagctactccggaggctgaggcaggagaatcgcttgaacctgggagacagaggttatggtgagtcgagattgcaacattgcactccatcctgggggcaacaagagtgaaactccatctcaaaaaaaaaagaaaaaaaaaaaaaga

SEQ ID NO: 3434 - DNA, 1222 bp, Artificial Sequence
  Synthetic polypeptide
atgtgtgtgggagagaagcgaagggcaatcattccttctcacttggcctatggaaaacggggatttccaccatctgtcccagccgcctgccttggcctcccgaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcctggccgccatcccatctgggaagtgaggagcgcctcttcccggccgccatcacatctaggaagtgaggagcgtctctgcccggccgcccatcgtctgggatgtggggagtgcctctgccccgccgccctgtctgggatgtgaggagcgcctctgcccggccgccaccccgtctgggaggtgaggagcgtctctgcccagccgccccgtctgagaagtgaggagaccctccgcccggcagctgccccgtctgagaagtgaggagcctctccgcccggcagccaccccgtccgggagggaggtgggggggtcagccccccgcccggccagccgccccatccgggaggtgaggggtgcctctgcccggccgcccctactgggaagtgaggagcccctctgcccggccgcccctactgggaagtgaggagcccctctgcccggccaccaccccgtctgggaggtgtgcccaacagctcattgagaacgggccaggatgacaatggcggctttgcggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagagttaagtggattaagggcggtgcaagatgtgctttgttaaacagatgcttgaaggcagcatgctcattaagagtcatcaccactccctaatctcaagtacccagggacacaaacgctgtggaaggccgcagggtcctctgcctaggaaaaccagagacctttgttcacttgtttatctgctgaccttccctccactattgtcctgtgaccctgccaaatccccctctgtgagaaacacccaagaatgatcaataaaaaaaaaaaaaaaagaaa

SEQ ID NO: 3435 - DNA, 1528 bp, Artificial Sequence
  Synthetic polypeptide
atgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagccgcctgccttggcctcccgaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcctggccgccatcccatctgggaagtgaggagcgcctcttcccggccgccatcacatctaggaagtgaggagcgtctctgcccggccgcccatcgtctgggatgtggggagtgcctctgccccgccgccctgtctgggatgtgaggagcgcctctgcccggccgccaccccgtctgggaggtgaggagcgtctctgcccagccgccccgtctgagaagtgaggagaccctccgcccggcagctgccccgtctgagaagtgaggagcctctccgcccggcagccaccccgtccgggagggaggtgggggggtcagccccccgcccggccagccgccccatccgggaggtgaggggtgcctctgcccggccgcccctactgggaagtgaggagcccctctgcccggccgcccctactgggaagtgaggagcccctctgcccggccaccaccccgtctgggaggtgtgcccaacagctcattgagaacgggccaggatgacaatggcggctttgcggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagagttaagtggattaagggcggtgcaagatgtgctttgttaaacagatgcttgaaggcagcatgctcattaagagtcatcaccactccctaatctcaagtacccagggacacaaacgctgtggaaggccgcagggtcctctgcctaggaaaaccagagacctttgttcacttgtttatctgctgaccttccctccactattgtcctgtgaccctgccaaatccccctctgtgagaaacacccaagaatgatcaataaaaaaaaaaaaaaaagaaa

SEQ ID NO: 3436 - DNA, 822 bp, Artificial Sequence; identical to SEQ ID NO: 119
  Synthetic polypeptide

SEQ ID NO: 3437 - DNA, 3992 bp, Artificial Sequence; identical to SEQ ID NO: 120
  Synthetic polypeptide

SEQ ID NO: 3438 - DNA, 3845 bp, Artificial Sequence; identical to SEQ ID NO: 121
  Synthetic polypeptide

SEQ ID NO: 3439 - DNA, 1221 bp, Artificial Sequence; identical to SEQ ID NO: 122
  Synthetic polypeptide

SEQ ID NO: 3440 - DNA, 1382 bp, Artificial Sequence; identical to SEQ ID NO: 1251
  Synthetic polypeptide

SEQ ID NO: 3441 - DNA, 389 bp, Artificial Sequence
  Synthetic polypeptide
atgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggacctgccgccgtgtcgcctctcatggcagacgggacctgcagatgggactgagtgatggacccaagacggaagagcttcctgggtgacctggaggcccagtgtcctcac

SEQ ID NO: 3442 - DNA, 1598 bp, Artificial Sequence; identical to SEQ ID NO: 1699
  Synthetic polypeptide

SEQ ID NO: 3443 - DNA, 2874 bp, Artificial Sequence
  Synthetic polypeptide
atgaagaacatttactgtcttattccgaagcttgtcaattttgcaactcttggctgcctatggatttctgtggtgcagtgtacagttttaaatagctgcctaaagtcgtgtgtaactaatctgggccagcagcttgaccttggcacaccacataatctgagtgaaccgtgtatccaaggatgtcacttttggaactctgtagatcagaaaaactgtgctttaaagtgtaatgatacttatgccaccgtttgtgagcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccagcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagaggtctacagcttcactcctgaggccagtgagaccacgaacccagtgagaggaatgagcgactccagatgcgccaccttaagagctgtaacactcaccacgaaggtctgcagcttcactcctgaagccagagagaccacgaacccaccagaaggaagaaactccaaacacatccgaacatcagaaggaacaaactctggacacaccacctttaagaactgtaacgctcaccacgagggtctgtggtttcattcttgaagtcagtcagaaaaagaacccaccagttccggaaaca

SEQ ID NO: 3444 - DNA, 2889 bp, Artificial Sequence
  Synthetic polypeptide
atgaagaacatttactgtcttattccgaagcttgtcaattttgcaactcttggctgcctatggatttctgtggtgcagtgtacagttttaaatagctgcctaaagtcgtgtgtaactaatctgggccagcagcttgaccttggcacaccacataatctgagtgaaccgtgtatccaaggatgtcacttttggaactctgtagatcagaaaaactgtgctttaaagtgtcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccaatgtcatcctgatcagtgatattattgaactctttgaattaggcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagaggtctacagcttcactcctgaggccagtgagaccacgaacccagtgagaggaatgagcgactccagatgcgccaccttaagagctgtaacactcaccacgaaggtctgcagcttcactcctgaagccagagagaccacgaacccaccagaaggaagaaactccaaacacatccgaacatcagaaggaacaaactctggacacaccacctttaagaactgtaacgctcaccacgagggtctgtggtttcattcttgaagtcagtcagaaaaagaacccaccagttccggaaaca

SEQ ID NO: 3445 - DNA, 1833 bp, Artificial Sequence; identical to SEQ ID NO: 126
  Synthetic polypeptide

SEQ ID NO: 3446 - DNA, 2151 bp, Artificial Sequence; identical to SEQ ID NO: 127
  Synthetic polypeptide

SEQ ID NO: 3447 - DNA, 1239 bp, Artificial Sequence; identical to SEQ ID NO: 129
  Synthetic polypeptide

SEQ ID NO: 3448 - DNA, 1200 bp, Artificial Sequence; identical to SEQ ID NO: 130
  Synthetic polypeptide

SEQ ID NO: 3449 - DNA, 776 bp, Artificial Sequence; identical to SEQ ID NO: 131
  Synthetic polypeptide

SEQ ID NO: 3450 - DNA, 737 bp, Artificial Sequence; identical to SEQ ID NO: 132
  Synthetic polypeptide

SEQ ID NO: 3451 - DNA, 1834 bp, Artificial Sequence; identical to SEQ ID NO: 133
  Synthetic polypeptide

SEQ ID NO: 3452 - DNA, 1765 bp, Artificial Sequence; identical to SEQ ID NO: 135
  Synthetic polypeptide

SEQ ID NO: 3453 - DNA, 645 bp, Artificial Sequence; identical to SEQ ID NO: 137
  Synthetic polypeptide

SEQ ID NO: 3454 - DNA, 980 bp, Artificial Sequence; identical to SEQ ID NO: 139
  Synthetic polypeptide

SEQ ID NO: 3455 - DNA, 1256 bp, Artificial Sequence; identical to SEQ ID NO: 140
  Synthetic polypeptide

SEQ ID NO: 3456 - DNA, 1277 bp, Artificial Sequence; identical to SEQ ID NO: 142
  Synthetic polypeptide

SEQ ID NO: 3457 - DNA, 128 bp, Artificial Sequence; identical to SEQ ID NO: 144
  Synthetic polypeptide

SEQ ID NO: 3458 - DNA, 690 bp, Artificial Sequence; identical to SEQ ID NO: 145
  Synthetic polypeptide

SEQ ID NO: 3459 - DNA, 803 bp, Artificial Sequence; identical to SEQ ID NO: 152
  Synthetic polypeptide

SEQ ID NO: 3460 - DNA, 301 bp, Artificial Sequence; identical to SEQ ID NO: 147
  Synthetic polypeptide

SEQ ID NO: 3461 - DNA, 303 bp, Artificial Sequence; identical to SEQ ID NO: 148
  Synthetic polypeptide

SEQ ID NO: 3462 - DNA, 1094 bp, Artificial Sequence; identical to SEQ ID NO: 153
  Synthetic polypeptide

SEQ ID NO: 3463 - DNA, 423 bp, Artificial Sequence; identical to SEQ ID NO: 154
  Synthetic polypeptide

SEQ ID NO: 3464 - DNA, 1736 bp, Artificial Sequence; identical to SEQ ID NO: 156
  Synthetic polypeptide

SEQ ID NO: 3465 - DNA, 1724 bp, Artificial Sequence; identical to SEQ ID NO: 157
  Synthetic polypeptide

SEQ ID NO: 3466 - DNA, 3825 bp, Artificial Sequence; identical to SEQ ID NO: 158
  Synthetic polypeptide

SEQ ID NO: 3467 - DNA, 572 bp, Artificial Sequence; identical to SEQ ID NO: 159
  Synthetic polypeptide

SEQ ID NO: 3468 - DNA, 118 bp, Artificial Sequence; identical to SEQ ID NO: 162
  Synthetic polypeptide

SEQ ID NO: 3469 - DNA, 1520 bp, Artificial Sequence; identical to SEQ ID NO: 175
  Synthetic polypeptide

SEQ ID NO: 3470 - DNA, 1436 bp, Artificial Sequence; identical to SEQ ID NO: 176
  Synthetic polypeptide

SEQ ID NO: 3471 - DNA, 1265 bp, Artificial Sequence; identical to SEQ ID NO: 177
  Synthetic polypeptide

SEQ ID NO: 3472 - DNA, 610 bp, Artificial Sequence; identical to SEQ ID NO: 163
  Synthetic polypeptide

SEQ ID NO: 3473 - DNA, 103 bp, Artificial Sequence; identical to SEQ ID NO: 173
  Synthetic polypeptide

SEQ ID NO: 3474 - DNA, 681 bp, Artificial Sequence; identical to SEQ ID NO: 174
  Synthetic polypeptide

SEQ ID NO: 3475 - DNA, 729 bp, Artificial Sequence; identical to SEQ ID NO: 202
  Synthetic polypeptide

SEQ ID NO: 3476 - DNA, 500 bp, Artificial Sequence; identical to SEQ ID NO: 204
  Synthetic polypeptide

SEQ ID NO: 3477 - DNA, 656 bp, Artificial Sequence; identical to SEQ ID NO: 205
  Synthetic polypeptide

SEQ ID NO: 3478 - DNA, 524 bp, Artificial Sequence; identical to SEQ ID NO: 207
  Synthetic polypeptide

SEQ ID NO: 3479 - DNA, 1363 bp, Artificial Sequence; identical to SEQ ID NO: 209
  Synthetic polypeptide

SEQ ID NO: 3480 - DNA, 423 bp, Artificial Sequence; identical to SEQ ID NO: 179
  Synthetic polypeptide

SEQ ID NO: 3481 - DNA, 657 bp, Artificial Sequence; identical to SEQ ID NO: 180
  Synthetic polypeptide

SEQ ID NO: 3482 - DNA, 1313 bp, Artificial Sequence; identical to SEQ ID NO: 182
  Synthetic polypeptide

SEQ ID NO: 3483 - DNA, 1253 bp, Artificial Sequence; identical to SEQ ID NO: 183
  Synthetic polypeptide

SEQ ID NO: 3484 - DNA, 1259 bp, Artificial Sequence; identical to SEQ ID NO: 185
  Synthetic polypeptide

SEQ ID NO: 3485 - DNA, 1250 bp, Artificial Sequence; identical to SEQ ID NO: 187
  Synthetic polypeptide

SEQ ID NO: 3486 - DNA, 298 bp, Artificial Sequence; identical to SEQ ID NO: 190
  Synthetic polypeptide

SEQ ID NO: 3487 - DNA, 316 bp, Artificial Sequence; identical to SEQ ID NO: 191
  Synthetic polypeptide

SEQ ID NO: 3488 - DNA, 211 bp, Artificial Sequence; identical to SEQ ID NO: 193
  Synthetic polypeptide

SEQ ID NO: 3489 - DNA, 439 bp, Artificial Sequence; identical to SEQ ID NO: 198
  Synthetic polypeptide

SEQ ID NO: 3490 - DNA, 301 bp, Artificial Sequence; identical to SEQ ID NO: 199
  Synthetic polypeptide

SEQ ID NO: 3491 - DNA, 478 bp, Artificial Sequence; identical to SEQ ID NO: 200
  Synthetic polypeptide

SEQ ID NO: 3492 - DNA, 381 bp, Artificial Sequence; identical to SEQ ID NO: 201
  Synthetic polypeptide

SEQ ID NO: 3493 - DNA, 2370 bp, Artificial Sequence; identical to SEQ ID NO: 210
  Synthetic polypeptide

SEQ ID NO: 3494 - DNA, 2259 bp, Artificial Sequence; identical to SEQ ID NO: 212
  Synthetic polypeptide

SEQ ID NO: 3495 - DNA, 775 bp, Artificial Sequence; identical to SEQ ID NO: 215
  Synthetic polypeptide

SEQ ID NO: 3496 - DNA, 2153 bp, Artificial Sequence; identical to SEQ ID NO: 217
  Synthetic polypeptide

SEQ ID NO: 3497 - DNA, 1766 bp, Artificial Sequence; identical to SEQ ID NO: 221
  Synthetic polypeptide

SEQ ID NO: 3498 - DNA, 1664 bp, Artificial Sequence; identical to SEQ ID NO: 222
  Synthetic polypeptide

SEQ ID NO: 3499 - DNA, 3525 bp, Artificial Sequence; identical to SEQ ID NO: 214
  Synthetic polypeptide

SEQ ID NO: 3500 - DNA, 91 bp, Artificial Sequence; identical to SEQ ID NO: 223
  Synthetic polypeptide

SEQ ID NO: 3501 - DNA, 1049 bp, Artificial Sequence; identical to SEQ ID NO: 224
  Synthetic polypeptide

SEQ ID NO: 3502 - DNA, 499 bp, Artificial Sequence; identical to SEQ ID NO: 225
  Synthetic polypeptide

SEQ ID NO: 3503 - DNA, 3220 bp, Artificial Sequence; identical to SEQ ID NO: 248
  Synthetic polypeptide

SEQ ID NO: 3504 - DNA, 609 bp, Artificial Sequence; identical to SEQ ID NO: 249
  Synthetic polypeptide

SEQ ID NO: 3505 - DNA, 738 bp, Artificial Sequence; identical to SEQ ID NO: 250
  Synthetic polypeptide

SEQ ID NO: 3506 - DNA, 537 bp, Artificial Sequence; identical to SEQ ID NO: 251
  Synthetic polypeptide

SEQ ID NO: 3507 - DNA, 684 bp, Artificial Sequence; identical to SEQ ID NO: 253
  Synthetic polypeptide

SEQ ID NO: 3508 - DNA, 552 bp, Artificial Sequence; identical to SEQ ID NO: 254
  Synthetic polypeptide

SEQ ID NO: 3509 - DNA, 285 bp, Artificial Sequence; identical to SEQ ID NO: 255
  Synthetic polypeptide

SEQ ID NO: 3510 - DNA, 1416 bp, Artificial Sequence; identical to SEQ ID NO: 226
  Synthetic polypeptide

SEQ ID NO: 3511 - DNA, 1027 bp, Artificial Sequence; identical to SEQ ID NO: 227
  Synthetic polypeptide

SEQ ID NO: 3512 - DNA, 1114 bp, Artificial Sequence; identical to SEQ ID NO: 228
  Synthetic polypeptide

SEQ ID NO: 3513 - DNA, 553 bp, Artificial Sequence; identical to SEQ ID NO: 229
  Synthetic polypeptide

SEQ ID NO: 3514 - DNA, 1156 bp, Artificial Sequence; identical to SEQ ID NO: 231
  Synthetic polypeptide

SEQ ID NO: 3515 - DNA, 985 bp, Artificial Sequence; identical to SEQ ID NO: 232
  Synthetic polypeptide

SEQ ID NO: 3516 - DNA, 1069 bp, Artificial Sequence; identical to SEQ ID NO: 233
  Synthetic polypeptide

SEQ ID NO: 3517 - DNA, 1072 bp, Artificial Sequence; identical to SEQ ID NO: 234
  Synthetic polypeptide

SEQ ID NO: 3518 - DNA, 943 bp, Artificial Sequence; identical to SEQ ID NO: 236
  Synthetic polypeptide

SEQ ID NO: 3519 - DNA, 459 bp, Artificial Sequence; identical to SEQ ID NO: 237
  Synthetic polypeptide

SEQ ID NO: 3520 - DNA, 3321 bp, Artificial Sequence; identical to SEQ ID NO: 242
  Synthetic polypeptide

SEQ ID NO: 3521 - DNA, 3429 bp, Artificial Sequence; identical to SEQ ID NO: 243
  Synthetic polypeptide

SEQ ID NO: 3522 - DNA, 3456 bp, Artificial Sequence; identical to SEQ ID NO: 244
  Synthetic polypeptide

SEQ ID NO: 3523 - DNA, 327 bp, Artificial Sequence; identical to SEQ ID NO: 246
  Synthetic polypeptide

SEQ ID NO: 3524 - DNA, 1052 bp, Artificial Sequence; identical to SEQ ID NO: 247
  Synthetic polypeptide

SEQ ID NO: 3525 - DNA, 82 bp, Artificial Sequence; identical to SEQ ID NO: 257
  Synthetic polypeptide

SEQ ID NO: 3526 - DNA, 102 bp, Artificial Sequence; identical to SEQ ID NO: 258
  Synthetic polypeptide

SEQ ID NO: 3527 - DNA, 1209 bp, Artificial Sequence; identical to SEQ ID NO: 281
  Synthetic polypeptide

SEQ ID NO: 3528 - DNA, 1206 bp, Artificial Sequence; identical to SEQ ID NO: 282
  Synthetic polypeptide

SEQ ID NO: 3529 - DNA, 1203 bp, Artificial Sequence; identical to SEQ ID NO: 286
  Synthetic polypeptide

SEQ ID NO: 3530 - DNA, 55 bp, Artificial Sequence; identical to SEQ ID NO: 291
  Synthetic polypeptide

SEQ ID NO: 3531 - DNA, 25 bp, Artificial Sequence
  Synthetic polypeptide
atgagcgtcctttcgtttttttaaa

SEQ ID NO: 3532 - DNA, 763 bp, Artificial Sequence; identical to SEQ ID NO: 261
  Synthetic polypeptide

SEQ ID NO: 3533 - DNA, 646 bp, Artificial Sequence; identical to SEQ ID NO: 262
  Synthetic polypeptide

SEQ ID NO: 3534 - DNA, 258 bp, Artificial Sequence; identical to SEQ ID NO: 265
  Synthetic polypeptide

SEQ ID NO: 3535 - DNA, 243 bp, Artificial Sequence; identical to SEQ ID NO: 267
  Synthetic polypeptide

SEQ ID NO: 3536 - DNA, 324 bp, Artificial Sequence; identical to SEQ ID NO: 268
  Synthetic polypeptide

SEQ ID NO: 3537 - DNA, 728 bp, Artificial Sequence; identical to SEQ ID NO: 269
  Synthetic polypeptide

SEQ ID NO: 3538 - DNA, 663 bp, Artificial Sequence; identical to SEQ ID NO: 271
  Synthetic polypeptide

SEQ ID NO: 3539 - DNA, 1682 bp, Artificial Sequence; identical to SEQ ID NO: 272
  Synthetic polypeptide

SEQ ID NO: 3540 - DNA, 1199 bp, Artificial Sequence; identical to SEQ ID NO: 273
  Synthetic polypeptide

SEQ ID NO: 3541 - DNA, 76 bp, Artificial Sequence; identical to SEQ ID NO: 274
  Synthetic polypeptide

SEQ ID NO: 3542 - DNA, 282 bp, Artificial Sequence; identical to SEQ ID NO: 277
  Synthetic polypeptide

SEQ ID NO: 3543 - DNA, 386 bp, Artificial Sequence; identical to SEQ ID NO: 278
  Synthetic polypeptide

SEQ ID NO: 3544 - DNA, 423 bp, Artificial Sequence; identical to SEQ ID NO: 279
  Synthetic polypeptide

SEQ ID NO: 3545 - DNA, 320 bp, Artificial Sequence; identical to SEQ ID NO: 280
  Synthetic polypeptide

SEQ ID NO: 3546 - DNA, 529 bp, Artificial Sequence; identical to SEQ ID NO: 287
  Synthetic polypeptide

SEQ ID NO: 3547 - DNA, 2161 bp, Artificial Sequence; identical to SEQ ID NO: 288
  Synthetic polypeptide

SEQ ID NO: 3548 - DNA, 2140 bp, Artificial Sequence; identical to SEQ ID NO: 289
  Synthetic polypeptide

SEQ ID NO: 3549 - DNA, 377 bp, Artificial Sequence; identical to SEQ ID NO: 299
  Synthetic polypeptide

SEQ ID NO: 3550 - DNA, 377 bp, Artificial Sequence; identical to SEQ ID NO: 300
  Synthetic polypeptide

SEQ ID NO: 3551 - DNA, 1072 bp, Artificial Sequence; identical to SEQ ID NO: 307
  Synthetic polypeptide

SEQ ID NO: 3552 - DNA, 1055 bp, Artificial Sequence; identical to SEQ ID NO: 306
  Synthetic polypeptide

SEQ ID NO: 3553 - DNA, 503 bp, Artificial Sequence; identical to SEQ ID NO: 322
  Synthetic polypeptide

SEQ ID NO: 3554 - DNA, 1606 bp, Artificial Sequence; identical to SEQ ID NO: 327
  Synthetic polypeptide

SEQ ID NO: 3555 - DNA, 175 bp, Artificial Sequence; identical to SEQ ID NO: 329
  Synthetic polypeptide

SEQ ID NO: 3556 - DNA, 3628 bp, Artificial Sequence; identical to SEQ ID NO: 330
  Synthetic polypeptide

SEQ ID NO: 3557 - DNA, 3127 bp, Artificial Sequence; identical to SEQ ID NO: 332
  Synthetic polypeptide

SEQ ID NO: 3558 - DNA, 137 bp, Artificial Sequence; identical to SEQ ID NO: 336
  Synthetic polypeptide

SEQ ID NO: 3559 - DNA, 451 bp, Artificial Sequence; identical to SEQ ID NO: 339
  Synthetic polypeptide

SEQ ID NO: 3560 - DNA, 3093 bp, Artificial Sequence; identical to SEQ ID NO: 341
  Synthetic polypeptide

SEQ ID NO: 3561 - DNA, 2979 bp, Artificial Sequence; identical to SEQ ID NO: 342
  Synthetic polypeptide

SEQ ID NO: 3562 - DNA, 3078 bp, Artificial Sequence; identical to SEQ ID NO: 343
  Synthetic polypeptide

SEQ ID NO: 3563 - DNA, 3072 bp, Artificial Sequence; identical to SEQ ID NO: 346
  Synthetic polypeptide

SEQ ID NO: 3564 - DNA, 1935 bp, Artificial Sequence; identical to SEQ ID NO: 347
  Synthetic polypeptide

SEQ ID NO: 3565 - DNA, 1096 bp, Artificial Sequence; identical to SEQ ID NO: 348
  Synthetic polypeptide

SEQ ID NO: 3566 - DNA, 902 bp, Artificial Sequence; identical to SEQ ID NO: 349
  Synthetic polypeptide

SEQ ID NO: 3567 - DNA, 874 bp, Artificial Sequence; identical to SEQ ID NO: 350
  Synthetic polypeptide

SEQ ID NO: 3568 - DNA, 196 bp, Artificial Sequence; identical to SEQ ID NO: 310
  Synthetic polypeptide

SEQ ID NO: 3569 - DNA, 355 bp, Artificial Sequence; identical to SEQ ID NO: 314
  Synthetic polypeptide

SEQ ID NO: 3570 - DNA, 225 bp, Artificial Sequence; identical to SEQ ID NO: 315
  Synthetic polypeptide

SEQ ID NO: 3571 - DNA, 516 bp, Artificial Sequence; identical to SEQ ID NO: 317
  Synthetic polypeptide

SEQ ID NO: 3572 - DNA, 890 bp, Artificial Sequence; identical to SEQ ID NO: 319
  Synthetic polypeptide

SEQ ID NO: 3573 - DNA, 947 bp, Artificial Sequence; identical to SEQ ID NO: 320
  Synthetic polypeptide

SEQ ID NO: 3574 - DNA, 637 bp, Artificial Sequence; identical to SEQ ID NO: 324
  Synthetic polypeptide

SEQ ID NO: 3575 - DNA, 950 bp, Artificial Sequence; identical to SEQ ID NO: 325
  Synthetic polypeptide

SEQ ID NO: 3576 - DNA, 1324 bp, Artificial Sequence; identical to SEQ ID NO: 326
  Synthetic polypeptide

SEQ ID NO: 3577 - DNA, 819 bp, Artificial Sequence; identical to SEQ ID NO: 333
  Synthetic polypeptide

SEQ ID NO: 3578 - DNA, 876 bp, Artificial Sequence; identical to SEQ ID NO: 334
  Synthetic polypeptide

SEQ ID NO: 3579 - DNA, 5853 bp, Artificial Sequence; identical to SEQ ID NO: 376
  Synthetic polypeptide

SEQ ID NO: 3580 - DNA, 5829 bp, Artificial Sequence; identical to SEQ ID NO: 377
  Synthetic polypeptide

SEQ ID NO: 3581 - DNA, 1950 bp, Artificial Sequence; identical to SEQ ID NO: 378
  Synthetic polypeptide

SEQ ID NO: 3582 - DNA, 2072 bp, Artificial Sequence; identical to SEQ ID NO: 379
  Synthetic polypeptide

SEQ ID NO: 3583 - DNA, 390 bp, Artificial Sequence; identical to SEQ ID NO: 380
  Synthetic polypeptide

SEQ ID NO: 3584 - DNA, 299 bp, Artificial Sequence; identical to SEQ ID NO: 383
  Synthetic polypeptide

SEQ ID NO: 3585 - DNA, 150 bp, Artificial Sequence; identical to SEQ ID NO: 384
  Synthetic polypeptide

SEQ ID NO: 3586 - DNA, 445 bp, Artificial Sequence; identical to SEQ ID NO: 387
  Synthetic polypeptide

SEQ ID NO: 3587 - DNA, 337 bp, Artificial Sequence; identical to SEQ ID NO: 390
  Synthetic polypeptide

SEQ ID NO: 3588 - DNA, 586 bp, Artificial Sequence; identical to SEQ ID NO: 401
  Synthetic polypeptide

SEQ ID NO: 3589 - DNA, 829 bp, Artificial Sequence; identical to SEQ ID NO: 402
  Synthetic polypeptide

SEQ ID NO: 3590 - DNA, 1060 bp, Artificial Sequence; identical to SEQ ID NO: 403
  Synthetic polypeptide

SEQ ID NO: 3591 - DNA, 730 bp, Artificial Sequence; identical to SEQ ID NO: 406
  Synthetic polypeptide

SEQ ID NO: 3592 - DNA, 496 bp, Artificial Sequence; identical to SEQ ID NO: 408
  Synthetic polypeptide

SEQ ID NO: 3593 - DNA, 392 bp, Artificial Sequence; identical to SEQ ID NO: 410
  Synthetic polypeptide

SEQ ID NO: 3594 - DNA, 1290 bp, Artificial Sequence; identical to SEQ ID NO: 425
  Synthetic polypeptide

SEQ ID NO: 3595 - DNA, 569 bp, Artificial Sequence; identical to SEQ ID NO: 426
  Synthetic polypeptide

SEQ ID NO: 3596 - DNA, 247 bp, Artificial Sequence; identical to SEQ ID NO: 427
  Synthetic polypeptide

SEQ ID NO: 3597 - DNA, 163 bp, Artificial Sequence; identical to SEQ ID NO: 351
  Synthetic polypeptide

SEQ ID NO: 3598 - DNA, 222 bp, Artificial Sequence; identical to SEQ ID NO: 355
  Synthetic polypeptide

SEQ ID NO: 3599 - DNA, 552 bp, Artificial Sequence; identical to SEQ ID NO: 356
  Synthetic polypeptide

SEQ ID NO: 3600 - DNA, 387 bp, Artificial Sequence; identical to SEQ ID NO: 359
  Synthetic polypeptide

SEQ ID NO: 3601 - DNA, 444 bp, Artificial Sequence; identical to SEQ ID NO: 360
  Synthetic polypeptide

SEQ ID NO: 3602 - DNA, 431 bp, Artificial Sequence; identical to SEQ ID NO: 364
  Synthetic polypeptide

SEQ ID NO: 3603 - DNA, 739 bp, Artificial Sequence; identical to SEQ ID NO: 365
  Synthetic polypeptide

SEQ ID NO: 3604 - DNA, 865 bp, Artificial Sequence; identical to SEQ ID NO: 366
  Synthetic polypeptide

SEQ ID NO: 3605 - DNA, 719 bp, Artificial Sequence; identical to SEQ ID NO: 367
  Synthetic polypeptide

SEQ ID NO: 3606 - DNA, 716 bp, Artificial Sequence; identical to SEQ ID NO: 369
  Synthetic polypeptide

SEQ ID NO: 3607 - DNA, 683 bp, Artificial Sequence; identical to SEQ ID NO: 372
  Synthetic polypeptide

SEQ ID NO: 3608 - DNA, 910 bp, Artificial Sequence; identical to SEQ ID NO: 391
  Synthetic polypeptide

SEQ ID NO: 3609 - DNA, 997 bp, Artificial Sequence; identical to SEQ ID NO: 392
  Synthetic polypeptide

SEQ ID NO: 3610 - DNA, 436 bp, Artificial Sequence; identical to SEQ ID NO: 393
  Synthetic polypeptide

SEQ ID NO: 3611 - DNA, 1039 bp, Artificial Sequence; identical to SEQ ID NO: 395
  Synthetic polypeptide

SEQ ID NO: 3612 - DNA, 868 bp, Artificial Sequence; identical to SEQ ID NO: 396
  Synthetic polypeptide

SEQ ID NO: 3613 - DNA, 952 bp, Artificial Sequence; identical to SEQ ID NO: 397
  Synthetic polypeptide

SEQ ID NO: 3614 - DNA, 955 bp, Artificial Sequence; identical to SEQ ID NO: 398
  Synthetic polypeptide

SEQ ID NO: 3615 - DNA, 826 bp, Artificial Sequence; identical to SEQ ID NO: 400
  Synthetic polypeptide

SEQ ID NO: 3616 - DNA, 441 bp, Artificial Sequence; identical to SEQ ID NO: 409
  Synthetic polypeptide

SEQ ID NO: 3617 - DNA, 721 bp, Artificial Sequence; identical to SEQ ID NO: 414
  Synthetic polypeptide

SEQ ID NO: 3618 - DNA, 1332 bp, Artificial Sequence; identical to SEQ ID NO: 422
  Synthetic polypeptide

SEQ ID NO: 3619 - DNA, 1254 bp, Artificial Sequence; identical to SEQ ID NO: 423
  Synthetic polypeptide

SEQ ID NO: 3620 - DNA, 3308 bp, Artificial Sequence; identical to SEQ ID NO: 428
  Synthetic polypeptide

SEQ ID NO: 3621 - DNA, 3203 bp, Artificial Sequence; identical to SEQ ID NO: 429
  Synthetic polypeptide

SEQ ID NO: 3622 - DNA, 2849 bp, Artificial Sequence; identical to SEQ ID NO: 430
  Synthetic polypeptide

SEQ ID NO: 3623 - DNA, 388 bp, Artificial Sequence; identical to SEQ ID NO: 431
  Synthetic polypeptide

SEQ ID NO: 3624 - DNA, 822 bp, Artificial Sequence; identical to SEQ ID NO: 119
  Synthetic polypeptide

SEQ ID NO: 3625 - DNA, 822 bp, Artificial Sequence; identical to SEQ ID NO: 119
  Synthetic polypeptide

SEQ ID NO: 3626 - DNA, 881 bp, Artificial Sequence; identical to SEQ ID NO: 2412
  Synthetic polypeptide

SEQ ID NO: 3627 - DNA, 803 bp, Artificial Sequence; identical to SEQ ID NO: 2413
  Synthetic polypeptide

SEQ ID NO: 3628 - DNA, 610 bp, Artificial Sequence; identical to SEQ ID NO: 163
  Synthetic polypeptide

SEQ ID NO: 3629 - DNA, 999 bp, Artificial Sequence; identical to SEQ ID NO: 983
  Synthetic polypeptide

SEQ ID NO: 3630 - DNA, 603 bp, Artificial Sequence; identical to SEQ ID NO: 1012
  Synthetic polypeptide

SEQ ID NO: 3631 - DNA, 567 bp, Artificial Sequence
  Synthetic polypeptide
atggaagccccggagggcggaggggggcctgcagcgcggggcccggagggcccggcgcccgaagccagggtgcacttccgagtggcgaggttcatcatggaggcaggaggctaaatattgatttcccaaagatgtccctatcctaatccctggaacctgtgaatgtcatcttatatagcaaaagagattttgaagatgtgattagagaccttaagatgggagatcatcctagattatctgggtgtaaccacacccatccttataaggcaaaggcaggaggagtcaccgtcagagaaggccacgtgaggacagaagcagagttagaagctttgaagatggaggaaggggccagcaaccaaggaatgcagccctcctctagaagctggaaaaggcaaggaaacattctcccatggagcctccagaaggagccagccctgcttagacgttgatcttagctttctaggctagttttggacttctgacttccaggatcggaggagtataaatgtgtgttgtttaagtggctgaatttgtggtgatttgttgcagtagccctagggaactgat

SEQ ID NO: 3632 - DNA, 1753 bp, Artificial Sequence; identical to SEQ ID NO: 2406
  Synthetic polypeptide

SEQ ID NO: 3633 - DNA, 1155 bp, Artificial Sequence; identical to SEQ ID NO: 2407
  Synthetic polypeptide

SEQ ID NO: 3634 - DNA, 193 bp, Artificial Sequence; identical to SEQ ID NO: 975
  Synthetic polypeptide

SEQ ID NO: 3635 - DNA, 371 bp, Artificial Sequence; identical to SEQ ID NO: 1008
  Synthetic polypeptide

SEQ ID NO: 3636 - DNA, 272 bp, Artificial Sequence; identical to SEQ ID NO: 1009
  Synthetic polypeptide

SEQ ID NO: 3637 - DNA, 2312 bp, Artificial Sequence; identical to SEQ ID NO: 1998
  Synthetic polypeptide

SEQ ID NO: 3638 - DNA, 1398 bp, Artificial Sequence; identical to SEQ ID NO: 948
  Synthetic polypeptide

SEQ ID NO: 3639 - DNA, 1302 bp, Artificial Sequence; identical to SEQ ID NO: 949
  Synthetic polypeptide

SEQ ID NO: 3640 - DNA, 721 bp, Artificial Sequence; identical to SEQ ID NO: 414
  Synthetic polypeptide

SEQ ID NO: 3641 - DNA, 143 bp, Artificial Sequence; identical to SEQ ID NO: 1010
  Synthetic polypeptide

SEQ ID NO: 3642 - DNA, 314 bp, Artificial Sequence; identical to SEQ ID NO: 1011
  Synthetic polypeptide

SEQ ID NO: 3643 - DNA, 714 bp, Artificial Sequence
  Synthetic polypeptide
atgctgccgtgcgccgcgggagccagggggcgtggggccatggtggtcttgcgggcggggaagaagacctttctcccccctctctgccgcgccttcgcctgccgcggctgtcaactcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtgcagtggctcactcctgtaatcccagcactctgggaggccaaggcgggcggatcatgaagtcaggagttcaagaccagtctgaccgatgtggtgaaaccccgtctttactagaaatacaaaaattagccaggtatggtggtgcgtgcctgtaatcccagctactcaggaggctgaggcaggagaatcgcttgaacccagaaggcagagtttgcagtgagccgagattgcgccactgcactccagcctgggtgacagagcaagactctgtctctaaataaataaataaa

SEQ ID NO: 3644 - DNA, 675 bp, Artificial Sequence
  Synthetic polypeptide
atggtggtcttgcgggcggggaagaagacctttctcccccctctctgccgcgccttcgcctgccgcggctgtcaactcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtgcagtggctcactcctgtaatcccagcactctgggaggccaaggcgggcggatcatgaagtcaggagttcaagaccagtctgaccgatgtggtgaaaccccgtctttactagaaatacaaaaattagccaggtatggtggtgcgtgcctgtaatcccagctactcaggaggctgaggcaggagaatcgcttgaacccagaaggcagagtttgcagtgagccgagattgcgccactgcactccagcctgggtgacagagcaagactctgtctctaaataaataaataaa

SEQ ID NO: 3645 - DNA, 600 bp, Artificial Sequence
  Synthetic polypeptide
ctcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtgcagtggctcactcctgtaatcccagcactctgggaggccaaggcgggcggatcatgaagtcaggagttcaagaccagtctgaccgatgtggtgaaaccccgtctttactagaaatacaaaaattagccaggtatggtggtgcgtgcctgtaatcccagctactcaggaggctgaggcaggagaatcgcttgaacccagaaggcagagtttgcagtgagccgagattgcgccactgcactccagcctgggtgacagagcaagactctgtctctaaataaataaataaa

SEQ ID NO: 3646 - DNA, 572 bp, Artificial Sequence; identical to SEQ ID NO: 159
  Synthetic polypeptide

SEQ ID NO: 3647 - DNA, 14 bp, Artificial Sequence
  Synthetic polypeptide
ccgacttctggaga

SEQ ID NO: 3648 - DNA, 39 bp, Artificial Sequence
  Synthetic polypeptide
atgagtaacgtgaatttgtccgtctccgacttctggaga

SEQ ID NO: 3649 - DNA, 464 bp, Artificial Sequence; identical to SEQ ID NO: 1863
  Synthetic polypeptide

SEQ ID NO: 3650 - DNA, 202 bp, Artificial Sequence
  Synthetic polypeptide
atggagaaaatcattcaagtggccaagacctctgctgcacaggcttataggcggaagggacttgccttgtctcagacgagatgttggactgtggacttttgagttaatgctaaaataagttaagactttgagggactgttgggaaggcatgattggtttcaaaatgtgaggacatgagatttaggagggatgaggagcggaa

SEQ ID NO: 3651 - DNA, 388 bp, Artificial Sequence
  Synthetic polypeptide
atggcggcggcctctgcggtgtcggtgctgctggtggcggcggagaggaaccggtggcatcgtctcccgagcctgctcctgccgccgaggacatgggtgtggaggcaaagaaccatgaagtacacaacagccacagatgaagcatattccatcggccccgctccctcccagcagagctacctatctatggagaaaatcattcaagtggccaagacctctgctgcacaggcttataggcggaagggacttgccttgtctcagacgagatgttggactgtggacttttgagttaatgctaaaataagttaagactttgagggactgttgggaaggcatgattggtttcaaaatgtgaggacatgagatttaggagggatgaggagcggaa

SEQ ID NO: 3652 - DNA, 529 bp, Artificial Sequence
  Synthetic polypeptide
atggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggcttataggcggaagggacttgccttgtctcagacgagatgttggactgtggacttttgagttaatgctaaaataagttaagactttgagggactgttgggaaggcatgattggtttcaaaatgtgaggacatgagatttaggagggatgaggagcggaa

SEQ ID NO: 3653 - DNA, 415 bp, Artificial Sequence
  Synthetic polypeptide
atgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggcttataggcggaagggacttgccttgtctcagacgagatgttggactgtggacttttgagttaatgctaaaataagttaagactttgagggactgttgggaaggcatgattggtttcaaaatgtgaggacatgagatttaggagggatgaggagcggaa

SEQ ID NO: 3654 - DNA, 2848 bp, Artificial Sequence
  Synthetic polypeptide
atggatgaacaggctctattagggctaaatccaaatgctgattcagactttagacaaagggccctggcctattttgagcagttaaaaatttccccagatgcctggcaggtgtgtgcagaagctctagcccagaggacatacagtgatgatcatgtgaagtttttctgctttcaagtactggaacatcaagttaaatacaaatactcagaactaaccactgttcaacaacagctaattagggagacgctcatatcatggctgcaagctcagatgctgaatccccaaccagagaagacctttatacgaaataaagccgcccaagtcttcgccttgctttttgttacagagtatctcactaagtggcccaagtttttttttgacattctctcagtagtggacctaaatccaaggggagtagatctctacctgcgaatcctcatggctattgattcagagttggtggatcgtgatgtggtgcatacatcagaggaggctcgtaggaatactctcataaaagataccatgagggaacagtgcattccaaatctggtggaatcatggtaccaaatattacaaaattatcagtttactaattctgaagtgacgtgtcagtgccttgaagtagttggggcttatgtctcttggatagacttatcccttatagccaatgataggtttataaatatgctgctaggtcatatgtcaatagaagttctacgggaagaagcatgtgactgtttatttgaagttgtaaataaaggaatggaccctgttgataaaatgaaactagtggaatctttgtgtcaagtattacagtctgctgggtttttcagcattgaccaggaagaagatgttgacttcctggccagattttctaagttggtaaatggaatgggacagtcattgatagttagttggagtaaattaattaagaatggggatattaagaatgctcaagaggcactacaagctattgaaacaaaagtggcactgatgttgcagctactaattcatgaggatgatgatatttcttctaatattattggattttgttacgattatcttcatattttgaaacagcttacagtgctctcggatcagcaaaaagctaatgtagaggcaatcatgttggccgttatgaaaaaattgacttacgatgaagaatataactttgaaaatgagggtgaagatgaagccatgtttgtagaatatagaaaacaactgaagttactgttggacaggcttgctcaagtttcaccagagttactactggcctctgttcgcagagtttttagttctacactgcagaattggcagactacacggtttatggaagttgaagtagcaataagattgctgtatatgttggcagaagctcttccagtatctcatggtgctcacttctcaggtgatgtttcaaaagctagtgctttgcaggatatgatgcgaactctggtaacatcaggagtcagttcctatcagcatacatctgtgacattggagttcttcgaaactgttgttagatatgaaaagtttttcacagttgaacctcagcacattccatgtgtactaatggctttcttagatcacagaggtctgcggcattccagtgcaaaagttcggagcaggacggcttacctgttttctagatttgtcaaatctctcaataagcaaatgaatcctttcattgaggatattttgaatagaatacaagatttattagagctttctccacctgagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaaaagttgatgctggcacaagatgaagaaaggcaagcctctctagcagactgtcttaaccatgctgttggatttgcaagtcgaaccagtaaagctttcagcaacaaacagactgtgaaacaatgtggctgttccgaagtttatctggactgtttacagacattcttgccagccctcagttgtcccttacaaaaggatattctcagaagtggagtccgtactttccttcatcgaatgattatttgcctggaggaagaagttcttccgttcattccatctgcttcagaacatatgctcaaagattgtgaagcaaaagatctccaggagttcattcctcttatcaaccagattacggccaaattcaagatacaggtatccccgtttttacaacagatgttcatgcccctgcttcatgcaatttttgaagtgctgctccggccagcagaagaaaatgaccagtctgctgctttagagaagcagatgttgcggaggagttactttgctttcctgcaaacagtcacaggcagtgggatgagcgaagttatagcaaatcaaggtgcagagaatgtagaaagagtgttggttactgttatccaaggagcagttgaatatccagatccaattgcacagaaaacatgttttatcatcctctcaaagttggtagaactctggggaggtaaagatggaccagtgggatttgctgattttgtttataagcacattgtccccgcatgtttcctagcacctttaaaacaaacctttgacctggcagatgcacaaacagtattggctttatctgagtgtgcagtgacactgaaaacaattcatctcaaacggggcccagaatgtgttcagtatcttcaacaagaatacctgccctccttgcaagtagctccagaaataattcaggagcctaataggcttttccagactgctgaaggggaccacagca

SEQ ID NO: 3655 - DNA, 592 bp, Artificial Sequence; identical to SEQ ID NO: 1986
  Synthetic polypeptide

SEQ ID NO: 3656 - DNA, 980 bp, Artificial Sequence; identical to SEQ ID NO: 139
  Synthetic polypeptide

SEQ ID NO: 3657 - DNA, 1256 bp, Artificial Sequence; identical to SEQ ID NO: 140
  Synthetic polypeptide

SEQ ID NO: 3658 - DNA, 1277 bp, Artificial Sequence; identical to SEQ ID NO: 142
  Synthetic polypeptide

SEQ ID NO: 3659 - DNA, 55 bp, Artificial Sequence; identical to SEQ ID NO: 291
  Synthetic polypeptide

SEQ ID NO: 3660 - DNA, 25 bp, Artificial Sequence
  Synthetic polypeptide
atgagcgtcctttcgtttttttaaa

SEQ ID NO: 3661 - DNA, 1770 bp, Artificial Sequence; identical to SEQ ID NO: 2055
  Synthetic polypeptide

SEQ ID NO: 3662 - DNA, 1465 bp, Artificial Sequence; identical to SEQ ID NO: 2056
  Synthetic polypeptide

SEQ ID NO: 3663 - DNA, 586 bp, Artificial Sequence; identical to SEQ ID NO: 401
  Synthetic polypeptide

SEQ ID NO: 3664 - DNA, 829 bp, Artificial Sequence; identical to SEQ ID NO: 402
  Synthetic polypeptide

SEQ ID NO: 3665 - DNA, 1060 bp, Artificial Sequence; identical to SEQ ID NO: 403
  Synthetic polypeptide

SEQ ID NO: 3666 - DNA, 730 bp, Artificial Sequence; identical to SEQ ID NO: 406
  Synthetic polypeptide

SEQ ID NO: 3667 - DNA, 496 bp, Artificial Sequence; identical to SEQ ID NO: 408
  Synthetic polypeptide

SEQ ID NO: 3668 - DNA, 568 bp, Artificial Sequence; identical to SEQ ID NO: 1967
  Synthetic polypeptide

SEQ ID NO: 3669 - DNA, 379 bp, Artificial Sequence; identical to SEQ ID NO: 1968
  Synthetic polypeptide

SEQ ID NO: 3670 - DNA, 1834 bp, Artificial Sequence; identical to SEQ ID NO: 133
  Synthetic polypeptide

SEQ ID NO: 3671 - DNA, 1765 bp, Artificial Sequence; identical to SEQ ID NO: 135
  Synthetic polypeptide

SEQ ID NO: 3672 - DNA, 2154 bp, Artificial Sequence; identical to SEQ ID NO: 1502
  Synthetic polypeptide

SEQ ID NO: 3673 - DNA, 2025 bp, Artificial Sequence; identical to SEQ ID NO: 1503
  Synthetic polypeptide

SEQ ID NO: 3674 - DNA, 890 bp, Artificial Sequence; identical to SEQ ID NO: 319
  Synthetic polypeptide

SEQ ID NO: 3675 - DNA, 947 bp, Artificial Sequence; identical to SEQ ID NO: 320
  Synthetic polypeptide

SEQ ID NO: 3676 - DNA, 652 bp, Artificial Sequence; identical to SEQ ID NO: 2065
  Synthetic polypeptide

SEQ ID NO: 3677 - DNA, 533 bp, Artificial Sequence; identical to SEQ ID NO: 1098
  Synthetic polypeptide

SEQ ID NO: 3678 - DNA, 102 bp, Artificial Sequence; identical to SEQ ID NO: 258
  Synthetic polypeptide

SEQ ID NO: 3679 - DNA, 82 bp, Artificial Sequence; identical to SEQ ID NO: 257
  Synthetic polypeptide

SEQ ID NO: 3680 - DNA, 609 bp, Artificial Sequence; identical to SEQ ID NO: 249
  Synthetic polypeptide

SEQ ID NO: 3681 - DNA, 738 bp, Artificial Sequence; identical to SEQ ID NO: 250
  Synthetic polypeptide

SEQ ID NO: 3682 - DNA, 537 bp, Artificial Sequence; identical to SEQ ID NO: 251
  Synthetic polypeptide

SEQ ID NO: 3683 - DNA, 684 bp, Artificial Sequence; identical to SEQ ID NO: 253
  Synthetic polypeptide

SEQ ID NO: 3684 - DNA, 285 bp, Artificial Sequence; identical to SEQ ID NO: 255
  Synthetic polypeptide

SEQ ID NO: 3685 - DNA, 552 bp, Artificial Sequence; identical to SEQ ID NO: 254
  Synthetic polypeptide

SEQ ID NO: 3686 - DNA, 266 bp, Artificial Sequence; identical to SEQ ID NO: 2578
  Synthetic polypeptide

SEQ ID NO: 3687 - DNA, 3825 bp, Artificial Sequence; identical to SEQ ID NO: 158
  Synthetic polypeptide

SEQ ID NO: 3688 - DNA, 763 bp, Artificial Sequence; identical to SEQ ID NO: 261
  Synthetic polypeptide

SEQ ID NO: 3689 - DNA, 646 bp, Artificial Sequence; identical to SEQ ID NO: 262
  Synthetic polypeptide

SEQ ID NO: 3690 - DNA, 677 bp, Artificial Sequence; identical to SEQ ID NO: 2175
  Synthetic polypeptide

SEQ ID NO: 3691 - DNA, 3220 bp, Artificial Sequence; identical to SEQ ID NO: 248
  Synthetic polypeptide

SEQ ID NO: 3692 - DNA, 775 bp, Artificial Sequence; identical to SEQ ID NO: 215
  Synthetic polypeptide

SEQ ID NO: 3693 - DNA, 1794 bp, Artificial Sequence
  Synthetic polypeptide
atgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttggaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagagagtaacattattcaggtataagaaaaaatgaagaagacttctatgttctattatggagtgatccctaagatacatttttaaatgagtaaagcaaagtggagagaagtgcaaatagtatattatc

SEQ ID NO: 3694 - DNA, 1845 bp, Artificial Sequence
  Synthetic polypeptide
atgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtgcagccgctgcattttttaacatgggatacctgttattttcattatttagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttggaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagagagtaacattattcaggtataagaaaaaatgaagaagacttctatgttctattatggagtgatccctaagatacatttttaaatgagtaaagcaaagtggagagaagtgcaaatagtatattatc

SEQ ID NO: 3695 - DNA, 1734 bp, Artificial Sequence
  Synthetic polypeptide
atgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaagaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagagagtaacattattcaggtataagaaaaaatgaagaagacttctatgttctattatggagtgatccctaagatacatttttaaatgagtaaagcaaagtggagagaagtgcaaatagtatattatc

SEQ ID NO: 3696 - DNA, 1785 bp, Artificial Sequence
  Synthetic polypeptide
atgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtgcagccgctgcattttttaacatgggatacctgttattttcattatttagtcccaacccctatgtctccctcctcgaaatcagtgagcactcccagtgaagctggaagccaagactcaggcgatctggggccattaacaagaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagagagtaacattattcaggtataagaaaaaatgaagaagacttctatgttctattatggagtgatccctaagatacatttttaaatgagtaaagcaaagtggagagaagtgcaaatagtatattatc

SEQ ID NO: 3697 - DNA, 876 bp, Artificial Sequence
  Synthetic polypeptide
atgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacaggcacatggatgaagctggaagccatcatcctcagcaaactaacacagaaacagaaaaccaaacaccgtgtgttcttccaacaagaatttatgaacacagggaggggaacaacacacaccagggccagtcgggagggtggagggcaagggaagggagtgcattgggacaaatcgctaatgcatgtggggcttaaaacctagatgacaggttaataggtgccgcaaactaccatggcgtacatatacctatgtaacaaacctacacgttctgcacttgtattccgaaacttaaagtaaaataaataaa

SEQ ID NO: 3698 - DNA, 786 bp, Artificial Sequence
  Synthetic polypeptide
atgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacaggcacatggatgaagctggaagccatcatcctcagcaaactaacacagaaacagaaaaccaaacaccgtgtgttcttccaacaagaatttatgaacacagggaggggaacaacacacaccagggccagtcgggagggtggagggcaagggaagggagtgcattgggacaaatcgctaatgcatgtggggcttaaaacctagatgacaggttaataggtgccgcaaactaccatggcgtacatatacctatgtaacaaacctacacgttctgcacttgtattccgaaacttaaagtaaaataaataaa

SEQ ID NO: 3699 - DNA, 594 bp, Artificial Sequence
  Synthetic polypeptide
agtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacaggcacatggatgaagctggaagccatcatcctcagcaaactaacacagaaacagaaaaccaaacaccgtgtgttcttccaacaagaatttatgaacacagggaggggaacaacacacaccagggccagtcgggagggtggagggcaagggaagggagtgcattgggacaaatcgctaatgcatgtggggcttaaaacctagatgacaggttaataggtgccgcaaactaccatggcgtacatatacctatgtaacaaacctacacgttctgcacttgtattccgaaacttaaagtaaaataaataaa

SEQ ID NO: 3700 - DNA, 816 bp, Artificial Sequence
  Synthetic polypeptide
atgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcaggcacttggaggtgtcccaggaagtcagccattactccccagtggaatggatccaactcgacaacaaggacatccaaatatgggtgggccaatgcagagaatgactcctccaagaggaatggtgcccttaggaccacaggcacatggatgaagctggaagccatcatcctcagcaaactaacacagaaacagaaaaccaaacaccgtgtgttcttccaacaagaatttatgaacacagggaggggaacaacacacaccagggccagtcgggagggtggagggcaagggaagggagtgcattgggacaaatcgctaatgcatgtggggcttaaaacctagatgacaggttaataggtgccgcaaactaccatggcgtacatatacctatgtaacaaacctacacgttctgcacttgtattccgaaacttaaagtaaaataaataaa

SEQ ID NO: 3701 - DNA, 864 bp, Artificial Sequence
  Synthetic polypeptide
atgcttgtgatcccctcagccctcatgtattcattcgtattatattggaggttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacaggcacatggatgaagctggaagccatcatcctcagcaaactaacacagaaacagaaaaccaaacaccgtgtgttcttccaacaagaatttatgaacacagggaggggaacaacacacaccagggccagtcgggagggtggagggcaagggaagggagtgcattgggacaaatcgctaatgcatgtggggcttaaaacctagatgacaggttaataggtgccgcaaactaccatggcgtacatatacctatgtaacaaacctacacgttctgcacttgtattccgaaacttaaagtaaaataaataaa

SEQ ID NO: 3702 - DNA, 573 bp, Artificial Sequence; identical to SEQ ID NO: 1369
  Synthetic polypeptide

SEQ ID NO: 3703 - DNA, 416 bp, Artificial Sequence; identical to SEQ ID NO: 1370
  Synthetic polypeptide

SEQ ID NO: 3704 - DNA, 500 bp, Artificial Sequence; identical to SEQ ID NO: 204
  Synthetic polypeptide

SEQ ID NO: 3705 - DNA, 656 bp, Artificial Sequence; identical to SEQ ID NO: 205
  Synthetic polypeptide

SEQ ID NO: 3706 - DNA, 524 bp, Artificial Sequence; identical to SEQ ID NO: 207
  Synthetic polypeptide

SEQ ID NO: 3707 - DNA, 3881 bp, Artificial Sequence; identical to SEQ ID NO: 1162
  Synthetic polypeptide

SEQ ID NO: 3708 - DNA, 3722 bp, Artificial Sequence; identical to SEQ ID NO: 1163
  Synthetic polypeptide

SEQ ID NO: 3709 - DNA, 118 bp, Artificial Sequence; identical to SEQ ID NO: 162
  Synthetic polypeptide

SEQ ID NO: 3710 - DNA, 434 bp, Artificial Sequence
  Synthetic polypeptide
atgtccgcccagaggttaatttctaacagaacctcccagcaatcggcatctaattctgattacacctgggaatatgaatattatgagattggaccagtttcctttgaaggactgaaggctcataaatattccattgtgattggattttgggttggtcttgcagtcttcgtgatttttatgttttttgtgctgaccttgctgaccaagacaggagccccacaccaagaattaccctccatgctgtgagtgggcctcatccagtcagttgaaggccttaagagaacaaagactgacctcctcaagccaaaagggattctaccaggacactgcctttggactgtctccaccctgccagcctactctacatatttgggacttgctggtccccaaagttacatgaggcaattccttaaaataaaactctctctttataa

SEQ ID NO: 3711 - DNA, 4277 bp, Artificial Sequence; identical to SEQ ID NO: 2069
  Synthetic polypeptide

SEQ ID NO: 3712 - DNA, 809 bp, Artificial Sequence; identical to SEQ ID NO: 2110
  Synthetic polypeptide

SEQ ID NO: 3713 - DNA, 644 bp, Artificial Sequence; identical to SEQ ID NO: 2111
  Synthetic polypeptide

SEQ ID NO: 3714 - DNA, 768 bp, Artificial Sequence; identical to SEQ ID NO: 2112
  Synthetic polypeptide

SEQ ID NO: 3715 - DNA, 427 bp, Artificial Sequence; identical to SEQ ID NO: 2113
  Synthetic polypeptide

SEQ ID NO: 3716 - DNA, 965 bp, Artificial Sequence; identical to SEQ ID NO: 1615
  Synthetic polypeptide

SEQ ID NO: 3717 - DNA, 1452 bp, Artificial Sequence
  Synthetic polypeptide
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaaagacttggaatgaacccaaatgtccatcaatgatagactggattaagaaaatgtggcacatatacaccatagaatactatgcagtcataaaaaaggatgagttcatgtcctttgtaggaacatggatgaagctggaaaccatcattctgagcaaactatcacaaggacagaaaaccaaacgccgcatgttctcattcacaggtgggaactgaacaatgagaacacttggacacagggcggggaacatcacacaccagggcctgtcggggggtaggggtagggaggcgggatggcattaacagaaatacctattgtaaatgacgagttaatgggtgcagcacaccaacatggcacatgtatacatatgtaacaaacctgcactttgtgcacatgtaccctagaacttaaagtaaaatttaaaaaaaagagaa

SEQ ID NO: 3718 - DNA, 1155 bp, Artificial Sequence
  Synthetic polypeptide
atggaatgtctctactatttcctgggatttctgctcctggctgcaagattgccacttgatgccgccaaacaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaaagacttggaatgaacccaaatgtccatcaatgatagactggattaagaaaatgtggcacatatacaccatagaatactatgcagtcataaaaaaggatgagttcatgtcctttgtaggaacatggatgaagctggaaaccatcattctgagcaaactatcacaaggacagaaaaccaaacgccgcatgttctcattcacaggtgggaactgaacaatgagaacacttggacacagggcggggaacatcacacaccagggcctgtcggggggtaggggtagggaggcgggatggcattaacagaaatacctattgtaaatgacgagttaatgggtgcagcacaccaacatggcacatgtatacatatgtaacaaacctgcactttgtgcacatgtaccctagaacttaaagtaaaatttaaaaaaaagagaa

SEQ ID NO: 3719 - DNA, 1278 bp, Artificial Sequence
  Synthetic polypeptide
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaaagacttggaatgaacccaaatgtccatcaatgatagactggattaagaaaatgtggcacatatacaccatagaatactatgcagtcataaaaaaggatgagttcatgtcctttgtaggaacatggatgaagctggaaaccatcattctgagcaaactatcacaaggacagaaaaccaaacgccgcatgttctcattcacaggtgggaactgaacaatgagaacacttggacacagggcggggaacatcacacaccagggcctgtcggggggtaggggtagggaggcgggatggcattaacagaaatacctattgtaaatgacgagttaatgggtgcagcacaccaacatggcacatgtatacatatgtaacaaacctgcactttgtgcacatgtaccctagaacttaaagtaaaatttaaaaaaaagagaa

SEQ ID NO: 3720 - DNA, 1052 bp, Artificial Sequence; identical to SEQ ID NO: 247
  Synthetic polypeptide

SEQ ID NO: 3721 - DNA, 327 bp, Artificial Sequence; identical to SEQ ID NO: 246
  Synthetic polypeptide

SEQ ID NO: 3722 - DNA, 2713 bp, Artificial Sequence; identical to SEQ ID NO: 1273
  Synthetic polypeptide

SEQ ID NO: 3723 - DNA, 228 bp, Artificial Sequence; identical to SEQ ID NO: 1274
  Synthetic polypeptide

SEQ ID NO: 3724 - DNA, 2567 bp, Artificial Sequence; identical to SEQ ID NO: 1766
  Synthetic polypeptide

SEQ ID NO: 3725 - DNA, 572 bp, Artificial Sequence; identical to SEQ ID NO: 1767
  Synthetic polypeptide

SEQ ID NO: 3726 - DNA, 1049 bp, Artificial Sequence; identical to SEQ ID NO: 224
  Synthetic polypeptide

SEQ ID NO: 3727 - DNA, 3628 bp, Artificial Sequence; identical to SEQ ID NO: 330
  Synthetic polypeptide

SEQ ID NO: 3728 - DNA, 3127 bp, Artificial Sequence; identical to SEQ ID NO: 332
  Synthetic polypeptide

SEQ ID NO: 3729 - DNA, 103 bp, Artificial Sequence; identical to SEQ ID NO: 173
  Synthetic polypeptide

SEQ ID NO: 3730 - DNA, 2648 bp, Artificial Sequence
  Synthetic polypeptide
atggaggtgacctgccttctacttctggcgctgatccccttccactgccggggacaaggagtctacgctccagcccaggcgcagatcgtgcatgcgggccaggcatgtgtggtgaaagaggacaatatcagcgagcgtgtctacaccatccgggagggggacaccctcatgctgcagtgccttgtaacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatgctgacggtgcaccagacggtgagcgatgtgcgaggcaacttctaccaggagaagacggtgttcctgcgctgtactgtcaactccaacccgcctgcccgcttcatctggaagcggggttccgataccctatcccacagccaggacaatggggttgacatctatgagcccctctacactcagggggagaccaaggtcctgaagctgaagaacctgcggccccaggactatgccagctacacctgccaggtgtctgtgcgtaacgtgtgcggcatcccagacaaggccatcaccttccggctcaccaacaccacggcaccaccagccctgaagctgtctgtgaacgaaactctggtggtgaaccctggggagaatgtgacggtgcagtgtctgctgacaggcggtgatcccctcccccagctgcagtggtcccatgggcctggcccactgcccctgggtgctctggcccagggtggcaccctcagcatcccttcagtgcaggcccgggactctggctactacaactgcacagccaccaacaatgtgggcaaccctgccaagaagactgtcaacctgctggtgcgatccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagtccccatgcttcccgccggaggtggagcccagttcccaggacgtgcgccaggcgctgggccggcccgtgctcctgcgctgctcgctgctgcgaggcagcccccagcgcatcgcctcggctgtgtggcgtttcaaagggcagctgctgccgccgccgcctgttgttcccgccgccgccgaggcgccggatcacgcggagctgcgcctcgacgccgtaactcgcgacagcagcggcagctacgagtgcagcgtctccaacgatgtgggctcggctgcctgcctcttccaggtctccgccaaagcctacagcccggagttttacttcgacacccccaaccccacccgcagccacaagctgtccaagaactactcctacgtgctgcagtggactcagagggagcccgacgctgtcgaccctgtgctcaactacagactcagcatccgccagttgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagctcctggctctgaggaccctgtcctctgacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggtggtgaaggttgcagtgagctgagattgtaccattgcactccatcctgggcagcaagagcaaaactccatttcaaaaaaaaaaaaggaaaaagaaaaga

SEQ ID NO: 3731 - DNA, 2636 bp, Artificial Sequence
  Synthetic polypeptide
atggaggtgacctgccttctacttctggcgctgatccccttccactgccggggacaaggagtctacgctccagcccaggcgcagatcgtgcatgcgggccaggcatgtgtggtgaaagaggacaatatcagcgagcgtgtctacaccatccgggagggggacaccctcatgctgcagtgccttgtaacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatgctgacggtgcaccagacggtgagcgatgtgcgaggcaacttctaccaggagaagacggtgttcctgcgctgtactgtcaactccaacccgcctgcccgcttcatctggaagcggggttccgataccctatcccacagccaggacaatggggttgacatctatgagcccctctacactcagggggagaccaaggtcctgaagctgaagaacctgcggccccaggactatgccagctacacctgccaggtgtctgtgcgtaacgtgtgcggcatcccagacaaggccatcaccttccggctcaccaacaccacggcaccaccagccctgaagctgtctgtgaacgaaactctggtggtgaaccctggggagaatgtgacggtgcagtgtctgctgacaggcggtgatcccctcccccagctgcagtggtcccatgggcctggcccactgcccctgggtgctctggcccagggtggcaccctcagcatcccttcagtgcaggcccgggactctggctactacaactgcacagccaccaacaatgtgggcaaccctgccaagaagactgtcaacctgctggtgcgatccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagttcccgccggaggtggagcccagttcccaggacgtgcgccaggcgctgggccggcccgtgctcctgcgctgctcgctgctgcgaggcagcccccagcgcatcgcctcggctgtgtggcgtttcaaagggcagctgctgccgccgccgcctgttgttcccgccgccgccgaggcgccggatcacgcggagctgcgcctcgacgccgtaactcgcgacagcagcggcagctacgagtgcagcgtctccaacgatgtgggctcggctgcctgcctcttccaggtctccgccaaagcctacagcccggagttttacttcgacacccccaaccccacccgcagccacaagctgtccaagaactactcctacgtgctgcagtggactcagagggagcccgacgctgtcgaccctgtgctcaactacagactcagcatccgccagttgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagcccatcaactctccgaacctttcagacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggtggtgaaggttgcagtgagctgagattgtaccattgcactccatcctgggcagcaagagcaaaactccatttcaaaaaaaaaaaaggaaaaagaaaaga

SEQ ID NO: 3732 - DNA, 565 bp, Artificial Sequence
  Synthetic polypeptide
tgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagcacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggtggtgaaggttgcagtgagctgagattgtaccattgcactccatcctgggcagcaagagcaaaactccatttcaaaaaaaaaaaaggaaaaagaaaaga

SEQ ID NO: 3733 - DNA, 1394 bp, Artificial Sequence; identical to SEQ ID NO: 1118
  Synthetic polypeptide

SEQ ID NO: 3734 - DNA, 1625 bp, Artificial Sequence; identical to SEQ ID NO: 1119
  Synthetic polypeptide

SEQ ID NO: 3735 - DNA, 1505 bp, Artificial Sequence; identical to SEQ ID NO: 1120
  Synthetic polypeptide

SEQ ID NO: 3736 - DNA, 1562 bp, Artificial Sequence; identical to SEQ ID NO: 1121
  Synthetic polypeptide

SEQ ID NO: 3737 - DNA, 1601 bp, Artificial Sequence; identical to SEQ ID NO: 1122
  Synthetic polypeptide

SEQ ID NO: 3738 - DNA, 1631 bp, Artificial Sequence; identical to SEQ ID NO: 1123
  Synthetic polypeptide

SEQ ID NO: 3739 - DNA, 2370 bp, Artificial Sequence; identical to SEQ ID NO: 210
  Synthetic polypeptide

SEQ ID NO: 3740 - DNA, 2259 bp, Artificial Sequence; identical to SEQ ID NO: 212
  Synthetic polypeptide

SEQ ID NO: 3741 - DNA, 1692 bp, Artificial Sequence; identical to SEQ ID NO: 1048
  Synthetic polypeptide

SEQ ID NO: 3742 - DNA, 1695 bp, Artificial Sequence; identical to SEQ ID NO: 1049
  Synthetic polypeptide

SEQ ID NO: 3743 - DNA, 466 bp, Artificial Sequence; identical to SEQ ID NO: 1050
  Synthetic polypeptide

SEQ ID NO: 3744 - DNA, 872 bp, Artificial Sequence
  Synthetic polypeptide
atggcaggtgggggcagcgacctgagcaccagggggctgaacggaggtgtttcacaagtagcaaatgagatgaaccatcttcctgcacacagccaaagtctgcaaaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagctttgaagatggaagagggaaccaaggaatgtggatgacctctagaagctgaaaaaacaaggaaatagtttgtcctttccagcccccagaaaggaatgaaggcctacaccttgactttaggcagtaagacccgtgtcacacttctcactgacataactggaagataatatatttgtgttgttttaaaccactaaatttgtggtaatttgttatggcagcaattaagagtaatac

SEQ ID NO: 3745 - DNA, 611 bp, Artificial Sequence
  Synthetic polypeptide
atgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagctttgaagatggaagagggaaccaaggaatgtggatgacctctagaagctgaaaaaacaaggaaatagtttgtcctttccagcccccagaaaggaatgaaggcctacaccttgactttaggcagtaagacccgtgtcacacttctcactgacataactggaagataatatatttgtgttgttttaaaccactaaatttgtggtaatttgttatggcagcaattaagagtaatac

SEQ ID NO: 3746 - DNA, 559 bp, Artificial Sequence; identical to SEQ ID NO: 1701
  Synthetic polypeptide

SEQ ID NO: 3747 - DNA, 639 bp, Artificial Sequence; identical to SEQ ID NO: 1176
  Synthetic polypeptide

SEQ ID NO: 3748 - DNA, 316 bp, Artificial Sequence; identical to SEQ ID NO: 2265
  Synthetic polypeptide

SEQ ID NO: 3749 - DNA, 299 bp, Artificial Sequence; identical to SEQ ID NO: 1033
  Synthetic polypeptide

SEQ ID NO: 3750 - DNA, 191 bp, Artificial Sequence; identical to SEQ ID NO: 1034
  Synthetic polypeptide

SEQ ID NO: 3751 - DNA, 832 bp, Artificial Sequence
  Synthetic polypeptide
atggctctacccaaagacgccatcccctcgctgtccgagtgccagtgcgggatctgcatggaaatcctcgtggagcccgtcaccctcccgtgtaaccacacgctgtgtaaaccgtgcttccagtcgaccgtcgaaaaggcgagtttatgctgtcccttctgtcgccgccgggtatcgtcgtggactcggtaccatacccgaagaaattctctcgtcaacgtggaactgtggacgataattcaaaaacactatcccagggagtgcaagcttagagcgtctggccaagaatcagaggaagtggctgatgactatcagccagttcgtctgctcagtaaacctggggaactgagaagagaatatgaagaggaaataagcaaggtggcggcagagcgacgggccagcgaggaagaagaaaacaaagccagtgaagaatacatacagaggttgttggcagaggaggaagaagaggaaaaaagacaggcagaaaaaaggcgaagagcgatggaagaacaactgaaaagtgatgaggaactggcaagaaagctaagcattgatattggtgcgatggctcgggcctgtaatcccagtacattgggaagctgaggcgagaggatcgcttgagcccaggagtttgagaccagcctgggcaacaaagtgagaccctgtttcttcagaaaaattaataatgagccgagtgtgatggtgcgtgcctggagctccacctgctgggaggggctgaggcaggaggatcccttgagcccaggagtttgaggttacagtgagctgatctcgccactgcacttcaacctggaagaccatctcaaaaaaaaaa

SEQ ID NO: 3752 - DNA, 819 bp, Artificial Sequence; identical to SEQ ID NO: 333
  Synthetic polypeptide

SEQ ID NO: 3753 - DNA, 876 bp, Artificial Sequence; identical to SEQ ID NO: 334
  Synthetic polypeptide

SEQ ID NO: 3754 - DNA, 4591 bp, Artificial Sequence; identical to SEQ ID NO: 2478
  Synthetic polypeptide

SEQ ID NO: 3755 - DNA, 4261 bp, Artificial Sequence; identical to SEQ ID NO: 2479
  Synthetic polypeptide

SEQ ID NO: 3756 - DNA, 506 bp, Artificial Sequence; identical to SEQ ID NO: 1096
  Synthetic polypeptide

SEQ ID NO: 3757 - DNA, 348 bp, Artificial Sequence
  Synthetic polypeptide
atggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttggaatatttgacaacgtctggagacagtgtctggcttgtcacagttggggaagataccacagatatctcgtgggtagaagccggggtgcagttaaatatcctatgaagcatataatgctgttctctacaacaaagaattgtctgacgttgctgaagttaagaaactctg

SEQ ID NO: 3758 - DNA, 1823 bp, Artificial Sequence; identical to SEQ ID NO: 2096
  Synthetic polypeptide

SEQ ID NO: 3759 - DNA, 1859 bp, Artificial Sequence; identical to SEQ ID NO: 2097
  Synthetic polypeptide

SEQ ID NO: 3760 - DNA, 1526 bp, Artificial Sequence; identical to SEQ ID NO: 2098
  Synthetic polypeptide

SEQ ID NO: 3761 - DNA, 1685 bp, Artificial Sequence; identical to SEQ ID NO: 2099
  Synthetic polypeptide

SEQ ID NO: 3762 - DNA, 1391 bp, Artificial Sequence; identical to SEQ ID NO: 1200
  Synthetic polypeptide

SEQ ID NO: 3763 - DNA, 467 bp, Artificial Sequence; identical to SEQ ID NO: 1201
  Synthetic polypeptide

SEQ ID NO: 3764 - DNA, 641 bp, Artificial Sequence; identical to SEQ ID NO: 1202
  Synthetic polypeptide

SEQ ID NO: 3765 - DNA, 377 bp, Artificial Sequence; identical to SEQ ID NO: 299
  Synthetic polypeptide

SEQ ID NO: 3766 - DNA, 377 bp, Artificial Sequence; identical to SEQ ID NO: 300
  Synthetic polypeptide

SEQ ID NO: 3767 - DNA, 698 bp, Artificial Sequence
  Synthetic polypeptide
atgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtgggcaccccctttgccttctgccgtgactggaggcttcctgaggccttactagaagctgagcagatgctgttaccatacttcccgtacagcctgcagaaccgtgagccaattaaacctcttttctttataaattacgcagcctcaggtattcctttatagcagtgcataaaatggccta

SEQ ID NO: 3768 - DNA, 488 bp, Artificial Sequence
  Synthetic polypeptide
atgttgtcccgaaggtacgaaggcgaaatacccaaaaatatttgcaagaggaagaaaacagtccaccaagtgacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtgggcaccccctttgccttctgccgtgactggaggcttcctgaggccttactagaagctgagcagatgctgttaccatacttcccgtacagcctgcagaaccgtgagccaattaaacctcttttctttataaattacgcagcctcaggtattcctttatagcagtgcataaaatggccta

SEQ ID NO: 3769 - DNA, 1416 bp, Artificial Sequence; identical to SEQ ID NO: 226
  Synthetic polypeptide

SEQ ID NO: 3770 - DNA, 3995 bp, Artificial Sequence; identical to SEQ ID NO: 2035
  Synthetic polypeptide

SEQ ID NO: 3771 - DNA, 3836 bp, Artificial Sequence; identical to SEQ ID NO: 2036
  Synthetic polypeptide

SEQ ID NO: 3772 - DNA, 732 bp, Artificial Sequence; identical to SEQ ID NO: 2476
  Synthetic polypeptide

SEQ ID NO: 3773 - DNA, 2161 bp, Artificial Sequence; identical to SEQ ID NO: 288
  Synthetic polypeptide

SEQ ID NO: 3774 - DNA, 2140 bp, Artificial Sequence; identical to SEQ ID NO: 289
  Synthetic polypeptide

SEQ ID NO: 3775 - DNA, 529 bp, Artificial Sequence; identical to SEQ ID NO: 287
  Synthetic polypeptide

SEQ ID NO: 3776 - DNA, 542 bp, Artificial Sequence
  Synthetic polypeptide
atgtcagggttcagtccggaactcatcgactacttggaagggaaaatctcctttgaggagttcgaacggcggagagaagagagaaaaacccgcgagaagaaaagtcttcaggaaaaaggcaagttatcagctgaagaaaatcccgatgactctgaagttccatcatcatcaggaattaactctaccaaatcccaagacaaagatgtcaatgaagggacatggatggagttggaagccgttatcctcagcaaaccaacacaggaacagaagaccaaacaccgcatgttctcacttataagtgggagctgaatgatgagaacacagggacaaaagggggtgaggaaacaacagacactggggccttttggattaggggtgttgcgggagggagagcatcaggaagaacagctgatagatgctgggcttaatatctaggtgatgggatgatctgtgcagcaaaccaccatggtacatgttgacctatgtaacaaacctggacatcctgcacatgtactcctgaacttaaaagatgaagaaaaaaa

SEQ ID NO: 3777 - DNA, 1035 bp, Artificial Sequence; identical to SEQ ID NO: 1131
  Synthetic polypeptide

SEQ ID NO: 3778 - DNA, 996 bp, Artificial Sequence; identical to SEQ ID NO: 1132
  Synthetic polypeptide

SEQ ID NO: 3779 - DNA, 1047 bp, Artificial Sequence; identical to SEQ ID NO: 1133
  Synthetic polypeptide

SEQ ID NO: 3780 - DNA, 1137 bp, Artificial Sequence; identical to SEQ ID NO: 1134
  Synthetic polypeptide

SEQ ID NO: 3781 - DNA, 1005 bp, Artificial Sequence; identical to SEQ ID NO: 1135
  Synthetic polypeptide

SEQ ID NO: 3782 - DNA, 1140 bp, Artificial Sequence; identical to SEQ ID NO: 1136
  Synthetic polypeptide

SEQ ID NO: 3783 - DNA, 1128 bp, Artificial Sequence; identical to SEQ ID NO: 1137
  Synthetic polypeptide

SEQ ID NO: 3784 - DNA, 1125 bp, Artificial Sequence; identical to SEQ ID NO: 1138
  Synthetic polypeptide

SEQ ID NO: 3785 - DNA, 1008 bp, Artificial Sequence; identical to SEQ ID NO: 1139
  Synthetic polypeptide

SEQ ID NO: 3786 - DNA, 943 bp, Artificial Sequence; identical to SEQ ID NO: 1140
  Synthetic polypeptide

SEQ ID NO: 3787 - DNA, 660 bp, Artificial Sequence; identical to SEQ ID NO: 1141
  Synthetic polypeptide

SEQ ID NO: 3788 - DNA, 593 bp, Artificial Sequence; identical to SEQ ID NO: 1142
  Synthetic polypeptide

SEQ ID NO: 3789 - DNA, 571 bp, Artificial Sequence; identical to SEQ ID NO: 2551
  Synthetic polypeptide

SEQ ID NO: 3790 - DNA, 3093 bp, Artificial Sequence; identical to SEQ ID NO: 341
  Synthetic polypeptide

SEQ ID NO: 3791 - DNA, 2979 bp, Artificial Sequence; identical to SEQ ID NO: 342
  Synthetic polypeptide

SEQ ID NO: 3792 - DNA, 3078 bp, Artificial Sequence; identical to SEQ ID NO: 343
  Synthetic polypeptide

SEQ ID NO: 3793 - DNA, 3072 bp, Artificial Sequence; identical to SEQ ID NO: 346
  Synthetic polypeptide

SEQ ID NO: 3794 - DNA, 1935 bp, Artificial Sequence; identical to SEQ ID NO: 347
  Synthetic polypeptide

SEQ ID NO: 3795 - DNA, 1096 bp, Artificial Sequence; identical to SEQ ID NO: 348
  Synthetic polypeptide

SEQ ID NO: 3796 - DNA, 902 bp, Artificial Sequence; identical to SEQ ID NO: 349
  Synthetic polypeptide

SEQ ID NO: 3797 - DNA, 874 bp, Artificial Sequence; identical to SEQ ID NO: 350
  Synthetic polypeptide

SEQ ID NO: 3798 - DNA, 1563 bp, Artificial Sequence
  Synthetic polypeptide
atggcgggaagcgagccgcgcagcggaacaaactcgccgccgccgcccttcagcgactggggccgcctggaggcggccatcctcagcggctggaagaccttctggcagtcagtgagcaaggagagggtggcgcgtacgacctcacgggaggaggtggatgaggcggccagcaccctgacgcggctgccgattgatgtacagctatatattttgtcctttctttcacctcatgatctgtgtcagttgggaagtacaaatcattattggaatgaaactgtaagagatccaattctgtggagatactttttgttgagggatcttccttcttggtcttctgttgactggaagtctcttccagatctagaaatcttaaaaaagcctatatctgaggtcactgatggtgcattttttgactacatggcagtctatagaatgtgctgtccatacacaagaagagcttcaaaatccagccgtcctatgtatggagctgtcacttcttttttacactccctgatcattcagaatgaaccacgatttgctatgtttggaccaggtttggaagaattgaatacctctttggtgttgagcttgatgtcttcagaggaactttgcccaacagctggtttgcctcagaggcagattgatggtattggatcaggagtcaattttcagttgaacaaccaacataaattcaacattctaatcttatattcaactaccagaaaggaaagagatagagcaagggaagagcatacaagtgcagttaacaagatgttcagtcgacacaatgaaggtgatgatcaacaaggaagccggtacagtgtgattccacagattcaaaaagtgtgtgaagttgtagatgggttcatctatgttgcaaatgctgaagctcataaaaggcagaattcagcagtcatgctggaacactgagaaagcctgcagcactgaggctctggtgcacagggcctacctaaggcctgaggctggaatgagaaaactgagaaatctccatgtccctaccaattaaggagcaacagcagactactgcagggatgggggaagggtgtggagaggctctccttgcctcttccccataacccccatggcacagttaacaagataggctgaaagctgagaacaagtagaaactctgagaaagaaactctggtactccagtgctgttactgagaacaagataggcagcagcatgctgctggaagaatttaaagtctgtgtgttacaaagttaactatagcaataaaagccaaatccagctcaactacagactagtttgattcagcctactgcattaataccctgaccgaagtatgatgcctgtttttaggagtaaatcctttttacctcagtctttattgctcttctacataaaacacctaacattaaatctaaaaattatgagacactcacaaaatcaaaatgaaatgatacattgtcatgagataaggcagtcagttgaactggaccagagatggtcagcatgttggtattctcagaaagggacattaaaataactgattaagagatctaggtcaggtacagtgg

SEQ ID NO: 3799 - DNA, 1640 bp, Artificial Sequence; identical to SEQ ID NO: 2480
  Synthetic polypeptide

SEQ ID NO: 3800 - DNA, 1435 bp, Artificial Sequence; identical to SEQ ID NO: 2481
  Synthetic polypeptide

SEQ ID NO: 3801 - DNA, 1628 bp, Artificial Sequence; identical to SEQ ID NO: 2482
  Synthetic polypeptide

SEQ ID NO: 3802 - DNA, 1775 bp, Artificial Sequence
  Synthetic polypeptide
atgccgcagctgagcctgtcctggctgggcctcgggcccgtggcagcatccccgtggctgcttctgctgctggttggaggctcctggctcctggcccgcgtcctggcctggacctacaccttctatgacaactgccgccgcctccagtgttttcctcaacccccgaaacagaactggttttggggacaccagggcctggtcactcccacggaagagggcatgaagacattgacccagctggtgaccacatatccccagggctttaagttgtggctgggtcctaccttccccctcctcattttatgccaccctgacattatccggcctatcaccagtgcctcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgacaagtggcagcgcctggcctcagagggcagcgccagactggacatgtttgaacacatcagcctcatgaccttggacagtctgcagaaatgtgtcttcagctttgaaagcaattgtcaggagaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgctgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggcattgtctgcctcatcaatattatcgggatccattacaacccaactgtgtggccagaccctgaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcaccctgctgcacttccgcatcctgccgacccacactgaaccccgcaggaaacccgagctgatattgcgcgcagagggtggactttggctgcgggtggagcccctggaggcataggatctggagccagactgcttgggctcaagtcctggctctgctgcgtgacttgagcaagttaattcctctctctgtgcctcggttccctcaaccatataatggagacaacagcattacctatatcagggttttcctgaggtctcaatataagggactcagagctgtgcctggcacacaatgaatgctaaatatatggagccattattatt

SEQ ID NO: 3803 - DNA, 800 bp, Artificial Sequence
  Synthetic polypeptide
atgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggcattgtctgcctcatcaatattatcgggatccattacaacccaactgtgtggccagaccctgaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcaccctgctgcacttccgcatcctgccgacccacactgaaccccgcaggaaacccgagctgatattgcgcgcagagggtggactttggctgcgggtggagcccctggaggcataggatctggagccagactgcttgggctcaagtcctggctctgctgcgtgacttgagcaagttaattcctctctctgtgcctcggttccctcaaccatataatggagacaacagcattacctatatcagggttttcctgaggtctcaatataagggactcagagctgtgcctggcacacaatgaatgctaaatatatggagccattattatt

SEQ ID NO: 3804 - DNA, 952 bp, Artificial Sequence; identical to SEQ ID NO: 1617
  Synthetic polypeptide

SEQ ID NO: 3805 - DNA, 1046 bp, Artificial Sequence
  Synthetic polypeptide
tagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagcctgccattacacatctttgcactggaattggtgcagatatataagtgatcctaatgttgatgctgcccagaccccaggaatgcagaggccttaagctccctggggataaggaccatgtttgtttcgctcaccactccatactcagtgtcctgcacagtacttgacacctagagaacacctggtagatgtttgt

SEQ ID NO: 3806 - DNA, 1332 bp, Artificial Sequence; identical to SEQ ID NO: 422
  Synthetic polypeptide

SEQ ID NO: 3807 - DNA, 1254 bp, Artificial Sequence; identical to SEQ ID NO: 423
  Synthetic polypeptide

SEQ ID NO: 3808 - DNA, 1068 bp, Artificial Sequence; identical to SEQ ID NO: 1221
  Synthetic polypeptide

SEQ ID NO: 3809 - DNA, 1248 bp, Artificial Sequence; identical to SEQ ID NO: 2552
  Synthetic polypeptide

SEQ ID NO: 3810 - DNA, 951 bp, Artificial Sequence; identical to SEQ ID NO: 2553
  Synthetic polypeptide

SEQ ID NO: 3811 - DNA, 1074 bp, Artificial Sequence; identical to SEQ ID NO: 2554
  Synthetic polypeptide

SEQ ID NO: 3812 - DNA, 965 bp, Artificial Sequence; identical to SEQ ID NO: 1035
  Synthetic polypeptide

SEQ ID NO: 3813 - DNA, 725 bp, Artificial Sequence; identical to SEQ ID NO: 1036
  Synthetic polypeptide

SEQ ID NO: 3814 - DNA, 899 bp, Artificial Sequence
  Synthetic polypeptide
caagtcgcctacgtgcgcgcccgggagctgcacactcttgaagtgaccggcctggagacggttgcccagagcaaggcccatgtagcatccctggagggcctcatccctgaagataaggttgtgcttctggcaggttctcccttacagaatgaagccaccctgggtcagtgtggggtggaagccctgacaaccctggaagtggttggccgcaggctaggagtgggaaaatgaaagatggattgatagcgccgcgtgtttcaagagaagtgggagcaagcatatttctttgtggaagtatagtcctatgtgtttaatatgtaaccaaactttgtctgtgtcaaaagaatacaactgaagatgtcattatgaaacaaaccatggtgagaattttgactagtttacagaaaagatgcatgatgaaaaactcaatgaacttagaaaaggactaaactttctacagcattaatcatcgaatacaaataaaataagtgatgctgctgtgaaatgcagttacataataagtgaaaaaattgtccgtgcttcaaaatcttttacagatggtgagtttataaaagactgtctattgagtgcagcggaaatcatgtgtcctgaacagaaagaagcatttgcagacataagcctaaccagaaaaactgttgctcagagagtaaaagatatggctgagaatttacaggataagttgtgagaaaaagtgagatcatttgtgacattttctattgcagttgatgagtgcacatatgtaaataatacaagtcagttaattatgtttatccatggtgttgctgagaattttgatatcattgaagaacttttagacatggtacctatggcagatccaaccactgaaagtgacttatttttgtatgttgaaaaaagtc

SEQ ID NO: 3815 - DNA, 2361 bp, Artificial Sequence; identical to SEQ ID NO: 1330
  Synthetic polypeptide

SEQ ID NO: 3816 - DNA, 2160 bp, Artificial Sequence; identical to SEQ ID NO: 1331
  Synthetic polypeptide

SEQ ID NO: 3817 - DNA, 1908 bp, Artificial Sequence; identical to SEQ ID NO: 1332
  Synthetic polypeptide

SEQ ID NO: 3818 - DNA, 2175 bp, Artificial Sequence; identical to SEQ ID NO: 1333
  Synthetic polypeptide

SEQ ID NO: 3819 - DNA, 620 bp, Artificial Sequence; identical to SEQ ID NO: 2592
  Synthetic polypeptide

SEQ ID NO: 3820 - DNA, 1292 bp, Artificial Sequence; identical to SEQ ID NO: 2593
  Synthetic polypeptide

SEQ ID NO: 3821 - DNA, 1400 bp, Artificial Sequence; identical to SEQ ID NO: 2594
  Synthetic polypeptide

SEQ ID NO: 3822 - DNA, 1310 bp, Artificial Sequence; identical to SEQ ID NO: 2595
  Synthetic polypeptide

SEQ ID NO: 3823 - DNA, 497 bp, Artificial Sequence; identical to SEQ ID NO: 2596
  Synthetic polypeptide

SEQ ID NO: 3824 - DNA, 412 bp, Artificial Sequence; identical to SEQ ID NO: 2597
  Synthetic polypeptide

SEQ ID NO: 3825 - DNA, 303 bp, Artificial Sequence; identical to SEQ ID NO: 148
  Synthetic polypeptide

SEQ ID NO: 3826 - DNA, 301 bp, Artificial Sequence; identical to SEQ ID NO: 147
  Synthetic polypeptide

SEQ ID NO: 3827 - DNA, 857 bp, Artificial Sequence; identical to SEQ ID NO: 1374
  Synthetic polypeptide

SEQ ID NO: 3828 - DNA, 1493 bp, Artificial Sequence; identical to SEQ ID NO: 1536
  Synthetic polypeptide

SEQ ID NO: 3829 - DNA, 1206 bp, Artificial Sequence; identical to SEQ ID NO: 282
  Synthetic polypeptide

SEQ ID NO: 3830 - DNA, 1209 bp, Artificial Sequence; identical to SEQ ID NO: 281
  Synthetic polypeptide

SEQ ID NO: 3831 - DNA, 1203 bp, Artificial Sequence; identical to SEQ ID NO: 286
  Synthetic polypeptide

SEQ ID NO: 3832 - DNA, 1094 bp, Artificial Sequence; identical to SEQ ID NO: 153
  Synthetic polypeptide

SEQ ID NO: 3833 - DNA, 128 bp, Artificial Sequence; identical to SEQ ID NO: 144
  Synthetic polypeptide

SEQ ID NO: 3834 - DNA, 121 bp, Artificial Sequence; identical to SEQ ID NO: 2158
  Synthetic polypeptide

SEQ ID NO: 3835 - DNA, 1216 bp, Artificial Sequence; identical to SEQ ID NO: 1380
  Synthetic polypeptide

SEQ ID NO: 3836 - DNA, 531 bp, Artificial Sequence; identical to SEQ ID NO: 2507
  Synthetic polypeptide

SEQ ID NO: 3837 - DNA, 294 bp, Artificial Sequence; identical to SEQ ID NO: 2508
  Synthetic polypeptide

SEQ ID NO: 3838 - DNA, 316 bp, Artificial Sequence; identical to SEQ ID NO: 2509
  Synthetic polypeptide

SEQ ID NO: 3839 - DNA, 798 bp, Artificial Sequence
  Synthetic polypeptide
atggacgcgctcaagtcggcggggcgggcgctgatccggagccccagcttggccaagcagagctgggggggcggtggccggcaccgcaagctgcctgagaactggacagacacgcgggagacgctgctggaggggatgctgttcagcctcaagtacctgggcatgacgctagtggagcagcccaagggtgaggagctgtcggccgccgccatcaagaggatcgtggctacagctaaggccagtgggaagaagctgcagaaggtgactctgaaggtgtcgccacggggaattatcctgacagacaacctcaccaaccagctcattgagaacgtgtccatatacaggatctcctattgcacagcagacaagatgcacgacaaggtgtttgcatacatcgcccagagccagcacaaccagagcctcgagtgccacgccttcctctgcaccaagcggaagatggcacaggctgttaccctcaccgtagcccaggccttcaaagtcgcctttgagttttggcaggtgtccaaggaagagaaagagaagagggacaaagccagccaagagggaggggacgtcctgggggcccgccaagactgcaccccctccttgaagagcttggtcgccactgggaacctgctggacttagaggagacagctaaggccccgctgtccacggtcagcgccaacaccaccaacatggacgaggtgccgcggccacaagccttgagtggcagcagtgttgtctgggagctggatgatggcctggatgaagcgttttcgagagatcctgactaatac

SEQ ID NO: 3840 - DNA, 1363 bp, Artificial Sequence; identical to SEQ ID NO: 209
  Synthetic polypeptide

SEQ ID NO: 3841 - DNA, 803 bp, Artificial Sequence; identical to SEQ ID NO: 152
  Synthetic polypeptide

SEQ ID NO: 3842 - DNA, 168 bp, Artificial Sequence
  Synthetic polypeptide
atgacccactctttggtttgtccagagacagtgagcagggtgagttcagtgctgaatcgcaacactcggcagtttggaaaaaaacatcttttcgaccaggatgaggagacatgttggaactcagaccaggactccactttttctgtaaaatggtgctgatgaccacct

SEQ ID NO: 3843 - DNA, 93 bp, Artificial Sequence
  Synthetic polypeptide
ggaaaaaaacatcttttcgaccaggatgaggagacatgttggaactcagaccaggactccactttttctgtaaaatggtgctgatgaccacct

SEQ ID NO: 3844 - DNA, 1097 bp, Artificial Sequence; identical to SEQ ID NO: 1040
  Synthetic polypeptide

SEQ ID NO: 3845 - DNA, 965 bp, Artificial Sequence; identical to SEQ ID NO: 1041
  Synthetic polypeptide

SEQ ID NO: 3846 - DNA, 1736 bp, Artificial Sequence; identical to SEQ ID NO: 156
  Synthetic polypeptide

SEQ ID NO: 3847 - DNA, 1724 bp, Artificial Sequence; identical to SEQ ID NO: 157
  Synthetic polypeptide

SEQ ID NO: 3848 - DNA, 168 bp, Artificial Sequence; identical to SEQ ID NO: 2538
  Synthetic polypeptide

SEQ ID NO: 3849 - DNA, 2557 bp, Artificial Sequence; identical to SEQ ID NO: 1524
  Synthetic polypeptide

SEQ ID NO: 3850 - DNA, 2428 bp, Artificial Sequence; identical to SEQ ID NO: 1525
  Synthetic polypeptide

SEQ ID NO: 3851 - DNA, 137 bp, Artificial Sequence
  Synthetic polypeptide
atgtgttctgaaattattttgaggcaagaagttttgaaagatggtttccacagttgattctaaatgaccaagctgtttccaaaaaagaaattatcttcaaaagatgaatatttgcccatattgaagatctttaaaag

SEQ ID NO: 3852 - DNA, 260 bp, Artificial Sequence
  Synthetic polypeptide
ctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagttgattctaaatgaccaagctgtttccaaaaaagaaattatcttcaaaagatgaatatttgcccatattgaagatctttaaaag

SEQ ID NO: 3853 - DNA, 233 bp, Artificial Sequence
  Synthetic polypeptide
gcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagttgattctaaatgaccaagctgtttccaaaaaagaaattatcttcaaaagatgaatatttgcccatattgaagatctttaaaag

SEQ ID NO: 3854 - DNA, 562 bp, Artificial Sequence; identical to SEQ ID NO: 1880
  Synthetic polypeptide

SEQ ID NO: 3855 - DNA, 519 bp, Artificial Sequence; identical to SEQ ID NO: 1571
  Synthetic polypeptide

SEQ ID NO: 3856 - DNA, 723 bp, Artificial Sequence; identical to SEQ ID NO: 1572
  Synthetic polypeptide

SEQ ID NO: 3857 - DNA, 483 bp, Artificial Sequence; identical to SEQ ID NO: 1573
  Synthetic polypeptide

SEQ ID NO: 3858 - DNA, 516 bp, Artificial Sequence; identical to SEQ ID NO: 1574
  Synthetic polypeptide

SEQ ID NO: 3859 - DNA, 117 bp, Artificial Sequence; identical to SEQ ID NO: 1575
  Synthetic polypeptide

SEQ ID NO: 3860 - DNA, 535 bp, Artificial Sequence; identical to SEQ ID NO: 2819
  Synthetic polypeptide

SEQ ID NO: 3861 - DNA, 5505 bp, Artificial Sequence; identical to SEQ ID NO: 1545
  Synthetic polypeptide

SEQ ID NO: 3862 - DNA, 5418 bp, Artificial Sequence; identical to SEQ ID NO: 1546
  Synthetic polypeptide

SEQ ID NO: 3863 - DNA, 1213 bp, Artificial Sequence; identical to SEQ ID NO: 1093
  Synthetic polypeptide

SEQ ID NO: 3864 - DNA, 616 bp, Artificial Sequence; identical to SEQ ID NO: 1094
  Synthetic polypeptide

SEQ ID NO: 3865 - DNA, 868 bp, Artificial Sequence; identical to SEQ ID NO: 1095
  Synthetic polypeptide

SEQ ID NO: 3866 - DNA, 729 bp, Artificial Sequence; identical to SEQ ID NO: 202
  Synthetic polypeptide

SEQ ID NO: 3867 - DNA, 569 bp, Artificial Sequence; identical to SEQ ID NO: 426
  Synthetic polypeptide

SEQ ID NO: 3868 - DNA, 1520 bp, Artificial Sequence; identical to SEQ ID NO: 175
  Synthetic polypeptide

SEQ ID NO: 3869 - DNA, 1436 bp, Artificial Sequence; identical to SEQ ID NO: 176
  Synthetic polypeptide

SEQ ID NO: 3870 - DNA, 1265 bp, Artificial Sequence; identical to SEQ ID NO: 177
  Synthetic polypeptide

SEQ ID NO: 3871 - DNA, 1259 bp, Artificial Sequence
  Synthetic polypeptide
atgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtgctg

SEQ ID NO: 3872 - DNA, 897 bp, Artificial Sequence; identical to SEQ ID NO: 2579
  Synthetic polypeptide

SEQ ID NO: 3873 - DNA, 839 bp, Artificial Sequence
  Synthetic polypeptide
atggtcagaaagcctgttgtgtccaccatctccaaaggaggttacctgcagggaaatgttaacgggaggctgccttccctgggcaacaaggagccacctgggcaggagaaagtgcagctgaagaggaaagtcactttactgaggggagtctccattatcattggcaccatcattggagcaggaatcttcatctctcctaagggcgtgctccagaacacgggcagcgtgggcatgtctctgaccatctggacggtgtgtggggtcctgtcactatttggagctttgtcttatgctgaattgggaacaactataaagaaatctggaggtcattacacatatattttggaagtctttggtccattaccagcttttgtacgagtctgggtggaactcctcataatacgccctgcagctactgctgtgatatccctggcatttggacgctacattctggaaccattttttattcaatgtgaaatccctgaacttgcgatcaagctcattacagctgtgggcataactgtagtgatggtcctaaatagcatgagtgtcagctggagcgcccggatccagattttcttaaccttttgcaagctcacagcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaagccagggctttgtctgtatcattactgctgtatccctgacagctggaa

SEQ ID NO: 3874 - DNA, 239 bp, Artificial Sequence
  Synthetic polypeptide
gcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaagccagggctttgtctgtatcattactgctgtatccctgacagctggaa

SEQ ID NO: 3875 - DNA, 441 bp, Artificial Sequence
  Synthetic polypeptide
atgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggcacagaaaatctgctaaggcagtaagaatttgcgaagtcaagatctagaggaaaagaagaaaaagttccagatatgtgagccctacatgtagggctgttt

SEQ ID NO: 3876 - DNA, 715 bp, Artificial Sequence; identical to SEQ ID NO: 1181
  Synthetic polypeptide

SEQ ID NO: 3877 - DNA, 589 bp, Artificial Sequence; identical to SEQ ID NO: 1182
  Synthetic polypeptide

SEQ ID NO: 3878 - DNA, 352 bp, Artificial Sequence; identical to SEQ ID NO: 1183
  Synthetic polypeptide

SEQ ID NO: 3879 - DNA, 180 bp, Artificial Sequence; identical to SEQ ID NO: 1184
  Synthetic polypeptide

SEQ ID NO: 3880 - DNA, 226 bp, Artificial Sequence; identical to SEQ ID NO: 1185
  Synthetic polypeptide

SEQ ID NO: 3881 - DNA, 280 bp, Artificial Sequence; identical to SEQ ID NO: 1186
  Synthetic polypeptide

SEQ ID NO: 3882 - DNA, 1288 bp, Artificial Sequence
  Synthetic polypeptide
atggcctgtccttggaaatttctgttcaagaccaaattccaccagtatgcaatgaatggggaaaaagacatcaacaacaatgtggagaaagccccctgtgccacctccagtccagtgacacaggatgaccttcagtatcacaacctcagcaagcagcagaatgagtccccgcagcccctcgtggagacgggaaagaagtctccagaatctctggtcaagctggatgcaaccccattgtcctccccacggcatgtgaggatcaaaaactggggcagcgggatgactttccaagacacacttcaccataaggccaaagggattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagaggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtcttcgatgcccgcagctgttccactgcccgggaaatgtttgaacacatctgcagacacgtgcgttactccaccaacaatggcaacatcaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcagctgtgcatcgacctgggctggaagcccaagtacggccgcttcgatgtggtccccctggtcctgcaggccaatggccgtgaccctgagctcttcgaaatcccacctgaccttgtgcttgaggtggccatggaacatcccaaatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgacgtccagcgctacaacatcctggaggaagtgggcaggagaatgggcctggaaacgcacaagctggcctcgctctggaaagaccaggctgtcgttgagatcaacattgctgtgctccatagtttccagcaaaact

SEQ ID NO: 3883 - DNA, 535 bp, Artificial Sequence; identical to SEQ ID NO: 2819
  Synthetic polypeptide

SEQ ID NO: 3884 - DNA, 912 bp, Artificial Sequence
  Synthetic polypeptide
atggcctgccgcccgcgaagcccgccgaggcatcagagccgctgcgacggtgacgccagctttaccactcctgaaggccctaaaccccgttccagatgctctgactgggcaagtgcagttgaagaagatgaaatgaggaccagagttaacaaagaaatggcaagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgagcccaagatggtgctagtctgaaaagccccacaggtgtggcttctaatgaactgaaccctattaagagtcacagaattaacatgggcggaagctgctgccaggctggactgaaagggccaggcaatacaagaggccttgaaccctcaggttcctaccagcgggaagtaggaagataaaactctccagctgcaaacacaggctgccttttgtgaaaaagaaggataattcagagatggagccaggagcctggaggactgaggctggcttaggggactgccaggtgatgtgtgcccagctggatttcagacttgctgtgggccagggactcct

SEQ ID NO: 3885 - DNA, 1029 bp, Artificial Sequence
  Synthetic polypeptide
atggcctgccgcccgcgaagcccgccgaggcatcagagccgctgcgacggtgacgccagcccgccgtcccccgcgcgatggagcctgggacggaagcgcagagccgacggcaggcgctggaggcccgaagacgccgaggaggcagagcaccgcggcgccgagcgcagacccgagagctttaccactcctgaaggccctaaaccccgttccagatgctctgactgggcaagtgcagttgaagaagatgaaatgaggaccagagttaacaaagaaatggcaagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgagcccaagatggtgctagtctgaaaagccccacaggtgtggcttctaatgaactgaaccctattaagagtcacagaattaacatgggcggaagctgctgccaggctggactgaaagggccaggcaatacaagaggccttgaaccctcaggttcctaccagcgggaagtaggaagataaaactctccagctgcaaacacaggctgccttttgtgaaaaagaaggataattcagagatggagccaggagcctggaggactgaggctggcttaggggactgccaggtgatgtgtgcccagctggatttcagacttgctgtgggccagggactcct

SEQ ID NO: 3886 - DNA, 1050 bp, Artificial Sequence
  Synthetic polypeptide
atggcctgccgcccgcgaagcccgccgaggcatcagagccgctgcgacggtgacgccagcccgccgtcccccgcgcgatggagcctgggacggaagcgcagagccgacggcaggcgctggaggcccgaagacgccgaggaggcagagcaccgcggcgccgagcgcagacccgagagctttaccactcctgaaggccctaaaccccgttccagatgctctgactgggcaagtgcagttgaagaagatgaaatgaggaccagagttaacaaagaaatggcaagcaatatttattttgccctcagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgagcccaagatggtgctagtctgaaaagccccacaggtgtggcttctaatgaactgaaccctattaagagtcacagaattaacatgggcggaagctgctgccaggctggactgaaagggccaggcaatacaagaggccttgaaccctcaggttcctaccagcgggaagtaggaagataaaactctccagctgcaaacacaggctgccttttgtgaaaaagaaggataattcagagatggagccaggagcctggaggactgaggctggcttaggggactgccaggtgatgtgtgcccagctggatttcagacttgctgtgggccagggactcct

SEQ ID NO: 3887 - DNA, 893 bp, Artificial Sequence
  Synthetic polypeptide
gcccagccgaccgcgtccctccccgcagcccgccgtcccccgcgcgatggagcctgggacggaagcgcagagccgacggcaggcgctggaggcccgaagacgccgaggaggcagagcaccgcggcgccgagcgcagacccgagagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgagcccaagatggtgctagtctgaaaagccccacaggtgtggcttctaatgaactgaaccctattaagagtcacagaattaacatgggcggaagctgctgccaggctggactgaaagggccaggcaatacaagaggccttgaaccctcaggttcctaccagcgggaagtaggaagataaaactctccagctgcaaacacaggctgccttttgtgaaaaagaaggataattcagagatggagccaggagcctggaggactgaggctggcttaggggactgccaggtgatgtgtgcccagctggatttcagacttgctgtgggccagggactcct

SEQ ID NO: 3888 - DNA, 924 bp, Artificial Sequence
  Synthetic polypeptide
atggcctgccgcccgcgaagcccgccgaggcatcagagccgctgcgacggtgacgccagcccgccgtcccccgcgcgatggagcctgggacggaagcgcagagccgacggcaggcgctggaggcccgaagacgccgaggaggcagagcaccgcggcgccgagcgcagacccgagagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgagcccaagatggtgctagtctgaaaagccccacaggtgtggcttctaatgaactgaaccctattaagagtcacagaattaacatgggcggaagctgctgccaggctggactgaaagggccaggcaatacaagaggccttgaaccctcaggttcctaccagcgggaagtaggaagataaaactctccagctgcaaacacaggctgccttttgtgaaaaagaaggataattcagagatggagccaggagcctggaggactgaggctggcttaggggactgccaggtgatgtgtgcccagctggatttcagacttgctgtgggccagggactcct

SEQ ID NO: 3889 - DNA, 4061 bp, Artificial Sequence
  Synthetic polypeptide
atggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtctctagtaacttataaaaagccgagtcattccttttgggagcctggcaaagggaagagagtccttcttgaccttcggccgaaacacccttaaa

SEQ ID NO: 3890 - DNA, 3893 bp, Artificial Sequence
  Synthetic polypeptide
atggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtctctagtaacttataaaaagccgagtcattccttttgggagcctggcaaagggaagagagtccttcttgaccttcggccgaaacacccttaaa

SEQ ID NO: 3891 - DNA, 3716 bp, Artificial Sequence
  Synthetic polypeptide
atggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtctctagtaacttataaaaagccgagtcattccttttgggagcctggcaaagggaagagagtccttcttgaccttcggccgaaacacccttaaa

SEQ ID NO: 3892 - DNA, 3884 bp, Artificial Sequence
  Synthetic polypeptide
atggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtctctagtaacttataaaaagccgagtcattccttttgggagcctggcaaagggaagagagtccttcttgaccttcggccgaaacacccttaaa

SEQ ID NO: 3893 - DNA, 4091 bp, Artificial Sequence
  Synthetic polypeptide
atggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggcagcacagtgatggacgaggaggaagcaggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtctctagtaacttataaaaagccgagtcattccttttgggagcctggcaaagggaagagagtccttcttgaccttcggccgaaacacccttaaa

SEQ ID NO: 3894 - DNA, 3786 bp, Artificial Sequence
  Synthetic polypeptide
ggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggcagcacagtgatggacgaggaggaagcaggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtctctagtaacttataaaaagccgagtcattccttttgggagcctggcaaagggaagagagtccttcttgaccttcggccgaaacacccttaaa

SEQ ID NO: 3895 - DNA, 393 bp, Artificial Sequence; identical to SEQ ID NO: 1400
  Synthetic polypeptide

SEQ ID NO: 3896 - DNA, 272 bp, Artificial Sequence; identical to SEQ ID NO: 1401
  Synthetic polypeptide

SEQ ID NO: 3897 - DNA, 925 bp, Artificial Sequence; identical to SEQ ID NO: 1209
  Synthetic polypeptide

SEQ ID NO: 3898 - DNA, 736 bp, Artificial Sequence; identical to SEQ ID NO: 1210
  Synthetic polypeptide

SEQ ID NO: 3899 - DNA, 755 bp, Artificial Sequence; identical to SEQ ID NO: 1211
  Synthetic polypeptide

SEQ ID NO: 3900 - DNA, 424 bp, Artificial Sequence; identical to SEQ ID NO: 1212
  Synthetic polypeptide

SEQ ID NO: 3901 - DNA, 285 bp, Artificial Sequence
  Synthetic polypeptide
atgaacgggacgcggaactggtgtaccctggtggacgtgcacccagaggaccaggcggcggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtctgggatgtagaaggcatcagtaaatgtttgttagactgaacagat

SEQ ID NO: 3902 - DNA, 462 bp, Artificial Sequence
  Synthetic polypeptide
atgaacgggacgcggaactggtgtaccctggtggacgtgcacccagaggaccaggcggcgggcagcgtggacattctcaggctgactctccagggtgaactgacaggagatgaacttgaacacatagcccagaaggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtctgggatgtagaaggcatcagtaaatgtttgttagactgaacagat

SEQ ID NO: 3903 - DNA, 387 bp, Artificial Sequence
  Synthetic polypeptide
atgaacgggacgcggaactggtgtaccctggtggacgtgcacccagaggaccaggcggcggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtctgggatgtagaaggcatcagtaaatgtttgttagactgaacagat

SEQ ID NO: 3904 - DNA, 519 bp, Artificial Sequence
  Synthetic polypeptide
atgagcagtccaggaatgacctctctacaactagagaaagaagaatgcatgcaatgtgttccctgtagtccaagaaccagggtagccctgctggagctctacagagccatgtgccagggcagcgtggacattctcaggctgactctccagggtgaactgacaggagatgaacttgaacacatagcccagaaggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtctgggatgtagaaggcatcagtaaatgtttgttagactgaacagat

SEQ ID NO: 3905 - DNA, 973 bp, Artificial Sequence
  Synthetic polypeptide
atgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggagggcaacagtcagaaaaattaagacaacttaaaatggaaaatctattctcagcagaaattttttgtaagtataaaaaaacgaaaatgagactataaccactgtaagtttctgattggcacatttgttacccaagcaaggagatccatttatcagtagtgattttattaaatcatgtttgattgcagccgctgaagaagtatgtgcactgaaaataaacttaagactatttaatggcgagagcagttgctcaaagagttgaggatatggggagatacagcaatatttaatttaaaaaacaaggcatatgatttcaaatgttttttggggtctta

SEQ ID NO: 3906 - DNA, 763 bp, Artificial Sequence
  Synthetic polypeptide
atgttgtcccgaaggtacgaaggcgaaatacccaaaaatatttgcaagaggaagaaaacagtccaccaagtgacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggagggcaacagtcagaaaaattaagacaacttaaaatggaaaatctattctcagcagaaattttttgtaagtataaaaaaacgaaaatgagactataaccactgtaagtttctgattggcacatttgttacccaagcaaggagatccatttatcagtagtgattttattaaatcatgtttgattgcagccgctgaagaagtatgtgcactgaaaataaacttaagactatttaatggcgagagcagttgctcaaagagttgaggatatggggagatacagcaatatttaatttaaaaaacaaggcatatgatttcaaatgttttttggggtctta

SEQ ID NO: 3907 - DNA, 770 bp, Artificial Sequence; identical to SEQ ID NO: 3389
  Synthetic polypeptide

SEQ ID NO: 3908 - DNA, 503 bp, Artificial Sequence; identical to SEQ ID NO: 322
  Synthetic polypeptide

SEQ ID NO: 3909 - DNA, 1470 bp, Artificial Sequence; identical to SEQ ID NO: 1592
  Synthetic polypeptide

SEQ ID NO: 3910 - DNA, 202 bp, Artificial Sequence; identical to SEQ ID NO: 1593
  Synthetic polypeptide

SEQ ID NO: 3911 - DNA, 569 bp, Artificial Sequence; identical to SEQ ID NO: 1768
  Synthetic polypeptide

SEQ ID NO: 3912 - DNA, 497 bp, Artificial Sequence; identical to SEQ ID NO: 1769
  Synthetic polypeptide

SEQ ID NO: 3913 - DNA, 1761 bp, Artificial Sequence
  Synthetic polypeptide
atggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggaggatcacttcagcccaggagttcaagactagcctgtgccacatagaccacatttctaccaaaaatcaaaaggaaaaaacttgctgggtgtggtgatgcacacctgtggtcccagctactcgggaggctgaggtgagaggattgctttagcttaggtggttgaggctgcagtgagccatgatagcaccactgcattccatccagcctgagggacggagtgagagcgacaccttgtctttaaaaaaaaaaa

SEQ ID NO: 3914 - DNA, 1563 bp, Artificial Sequence
  Synthetic polypeptide
atggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggaggatcacttcagcccaggagttcaagactagcctgtgccacatagaccacatttctaccaaaaatcaaaaggaaaaaacttgctgggtgtggtgatgcacacctgtggtcccagctactcgggaggctgaggtgagaggattgctttagcttaggtggttgaggctgcagtgagccatgatagcaccactgcattccatccagcctgagggacggagtgagagcgacaccttgtctttaaaaaaaaaaa

SEQ ID NO: 3915 - DNA, 92 bp, Artificial Sequence; identical to SEQ ID NO: 1765
  Synthetic polypeptide

SEQ ID NO: 3916 - DNA, 801 bp, Artificial Sequence
  Synthetic polypeptide
atgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccggggaatgaatggaaaaatcatctgtgttgcgttcacttaattgaataccaccaaacaaaaaaaggaatgaatgattgacatccccaacatcttggatggatgtaaaaagcttatgccaagtgaaataagccaatcactaaaaggctgtatgtatgattgattgc

SEQ ID NO: 3917 - DNA, 591 bp, Artificial Sequence
  Synthetic polypeptide
atgttgtcccgaaggtacgaaggcgaaatacccaaaaatatttgcaagaggaagaaaacagtccaccaagtgacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccggggaatgaatggaaaaatcatctgtgttgcgttcacttaattgaataccaccaaacaaaaaaaggaatgaatgattgacatccccaacatcttggatggatgtaaaaagcttatgccaagtgaaataagccaatcactaaaaggctgtatgtatgattgattgc

SEQ ID NO: 3918 - DNA, 517 bp, Artificial Sequence; identical to SEQ ID NO: 1304
  Synthetic polypeptide

SEQ ID NO: 3919 - DNA, 337 bp, Artificial Sequence; identical to SEQ ID NO: 1305
  Synthetic polypeptide

SEQ ID NO: 3920 - DNA, 746 bp, Artificial Sequence
  Synthetic polypeptide
atggcctggtcccctctcttcctcaccctcatcactcactgtgcagggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcaatggcctccagtgattccccaccctctggtattcctatctgtatatggtccattcccacatagcatcagggttgctctgggtgaccaagagtatacaacagagtgaagttattttacctccaaggctattataaaaaacattgcaatgccttccttgttctcttttggatcactcattctgtaggaagccagctgacatgtcatgaggaccatatgacaaggaacagagggaggcctcctgccaatacccaagtgagtttgaaagccctagtcaagcctttcacatgatatggccccagtcaacatcttaactgcaacctcatgaaagaagctgagacagcaccactcagttaagtgaccccaaattcctgaccctcggaaaccatgagataacaaatagtggtggttttagttgataagtttgcagtaatatattatacagcaataggtaactaataca

SEQ ID NO: 3921 - DNA, 3525 bp, Artificial Sequence; identical to SEQ ID NO: 214
  Synthetic polypeptide

SEQ ID NO: 3922 - DNA, 1134 bp, Artificial Sequence
  Synthetic polypeptide
atggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaatgggtaaccaaattgagtaaattcatgcgatggacgaccacgcagcaatagagagaatgaactgctggggacctgacggctgaaggcatcctacagccgtgatactgagcagaagcccatgatccggaagagcacctattctgcatgctggcatttttcataacattttcttaaatttttatttaaaagttttatggatctttccattaaatttaagaatatggaaaattcatctatagcaacagaaagcactgatcgcctgggatgggtgggggttggagaaggcagctcaggaacttatcagggacatgaaatgtctttgttttcatcagggaaggggtttagagtgtgcccacttgcggcaggtcataacctggatgcttaaaatgtatgcatttt

SEQ ID NO: 3923 - DNA, 431 bp, Artificial Sequence; identical to SEQ ID NO: 364
  Synthetic polypeptide

SEQ ID NO: 3924 - DNA, 6132 bp, Artificial Sequence; identical to SEQ ID NO: 1117
  Synthetic polypeptide

SEQ ID NO: 3925 - DNA, 615 bp, Artificial Sequence; identical to SEQ ID NO: 1055
  Synthetic polypeptide

SEQ ID NO: 3926 - DNA, 861 bp, Artificial Sequence; identical to SEQ ID NO: 1056
  Synthetic polypeptide

SEQ ID NO: 3927 - DNA, 62 bp, Artificial Sequence; identical to SEQ ID NO: 1057
  Synthetic polypeptide

SEQ ID NO: 3928 - DNA, 123 bp, Artificial Sequence; identical to SEQ ID NO: 1058
  Synthetic polypeptide

SEQ ID NO: 3929 - DNA, 712 bp, Artificial Sequence; identical to SEQ ID NO: 1187
  Synthetic polypeptide

SEQ ID NO: 3930 - DNA, 307 bp, Artificial Sequence; identical to SEQ ID NO: 2622
  Synthetic polypeptide

SEQ ID NO: 3931 - DNA, 2621 bp, Artificial Sequence
  Synthetic polypeptide
atgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccaactcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgtggaatctctgagcctggaccttttaagccaagaattgcttaaggtgtttcccacaccctgaattccagcagaacagctgacgccaactggtctgaaggccccaccaaggaaccgactcagctcaggaatgtggtttcttcatcccctatcccgtgacttcaccactcatactcaccaatcagcgatccccacgcctcagaccccatcacctgcccagacccctgaaaaacaccatccccaagcccctcgggaggtgggtttgaggtttcctcccatctcctcgcttggctgcccacgcgtcttggactttctctgtggcaactccctctctttcagtgtgctggtatatcaccatgcagtgggcaataggcc

SEQ ID NO: 3932 - DNA, 2450 bp, Artificial Sequence
  Synthetic polypeptide
atgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccaactcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgtggaatctctgagcctggaccttttaagccaagaattgcttaaggtgtttcccacaccctgaattccagcagaacagctgacgccaactggtctgaaggccccaccaaggaaccgactcagctcaggaatgtggtttcttcatcccctatcccgtgacttcaccactcatactcaccaatcagcgatccccacgcctcagaccccatcacctgcccagacccctgaaaaacaccatccccaagcccctcgggaggtgggtttgaggtttcctcccatctcctcgcttggctgcccacgcgtcttggactttctctgtggcaactccctctctttcagtgtgctggtatatcaccatgcagtgggcaataggcc

SEQ ID NO: 3933 - DNA, 459 bp, Artificial Sequence; identical to SEQ ID NO: 237
  Synthetic polypeptide

SEQ ID NO: 3934 - DNA, 1649 bp, Artificial Sequence; identical to SEQ ID NO: 2810
  Synthetic polypeptide

SEQ ID NO: 3935 - DNA, 1508 bp, Artificial Sequence; identical to SEQ ID NO: 2811
  Synthetic polypeptide

SEQ ID NO: 3936 - DNA, 782 bp, Artificial Sequence; identical to SEQ ID NO: 2812
  Synthetic polypeptide

SEQ ID NO: 3937 - DNA, 1504 bp, Artificial Sequence; identical to SEQ ID NO: 2813
  Synthetic polypeptide

SEQ ID NO: 3938 - DNA, 1007 bp, Artificial Sequence; identical to SEQ ID NO: 2814
  Synthetic polypeptide

SEQ ID NO: 3939 - DNA, 1629 bp, Artificial Sequence; identical to SEQ ID NO: 2518
  Synthetic polypeptide

SEQ ID NO: 3940 - DNA, 633 bp, Artificial Sequence
  Synthetic polypeptide
atgcactggggggttggctttgcttcgtccaggccgtgcgtggtggatctgagctggaaccagagcatctccttcttcggctggtgggccgggtccgaggagcccttctccttttatggggacatcatcgctttccctttgcaggattacggtgggatcatggcagggctgggctccgatccctggtggaagaaaaccctttacttgaccgggggagctttgctggccgcagctgcgtatctgctccacgaactcctggtcattaggaaacagcaagagattgactctaaagatgctattattttgcatcagtttgcaagacctaacaatggtgttccaagtttatctcctttctgtttaaagatggaaacttatttaaggatggctgacttaccgtatcagaactattttggtggaaaactctctgctcaagggaaaatgccttggattgaatataatcatgaaaaagtttctggcacagaattcataattgactttctggaagagaagcttggagtgaatttaaacaaaaaccttggccctcatgaaagagccatctccagagcggtgaccaagatggtggaggagcacttctactgccttccagccgttaacctttgcttttggaataaa

SEQ ID NO: 3941 - DNA, 397 bp, Artificial Sequence; identical to SEQ ID NO: 3335
  Synthetic polypeptide

SEQ ID NO: 3942 - DNA, 289 bp, Artificial Sequence; identical to SEQ ID NO: 3336
  Synthetic polypeptide

SEQ ID NO: 3943 - DNA, 468 bp, Artificial Sequence; identical to SEQ ID NO: 2580
  Synthetic polypeptide

SEQ ID NO: 3944 - DNA, 436 bp, Artificial Sequence
  Synthetic polypeptide
atggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagttagcaaagtgcctggcacata

SEQ ID NO: 3945 - DNA, 426 bp, Artificial Sequence
  Synthetic polypeptide
tggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagttagcaaagtgcctggcacata

SEQ ID NO: 3946 - DNA, 244 bp, Artificial Sequence
  Synthetic polypeptide
atcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagttagcaaagtgcctggcacata

SEQ ID NO: 3947 - DNA, 193 bp, Artificial Sequence; identical to SEQ ID NO: 975
  Synthetic polypeptide

SEQ ID NO: 3948 - DNA, 1476 bp, Artificial Sequence
  Synthetic polypeptide
atggcttgggccgcgctcctcggcctcctggccgcactgttgctgctgctgctactgagccgccgccgcacgcggcgacctggtgagcctcccctggacctgggcagcatcccctggttggggtatgccttggactttggaaaagatgctgccagcttcctcacgaggatgaaggagaagcacggtgacatctttactatactggttgggggcaggtatgtcaccgttctcctggacccacactcctacgacgcggtggtgtgggagcctcgcaccaggctcgacttccatgcctatgccatcttcctcatggagaggatttttgatgtgcagcttccacattacagccccagtgatgaaaaggccaggatgaaactgactcttctccacagagagctccaggcactcacagaagccatgtataccaacctccatgcagtgctgttgggcgatgctacagaagcaggcagtggctggcacgagatgggtctcctcgacttctcctacagcttcctgctcagagccggctacctgactctttacggaattgaggcgctgccacgcacccatgaaagccaggcccaggaccgcgtccactcagctgatgtcttccacacctttcgccagctcgaccggctgctccccaaactggcccgtggctccctgtcagtgggggacaaggaccacatgtgcagtgtcaaaagtcgcctgtggaagctgctatccccagccaggctggccaggcgggcccaccggagcaaatggctggagagttacctgctgcacctggaggagatgggtgtgtcagaggagatgcaggcacgggccctggtgctgcagctgtgggccacacaggggaatatgggtcccgctgccttctggctcctgctcttccttctcaagaatcctgaagccctggctgctgtccgcggagagctcgagagtatcctttggcaagcggagcagcctgtctcgcagacgaccactctcccacagaaggttctagacagcacacctgtgcttgatagcgtgctgagtgagagcctcaggcttacagctgcccccttcatcacccgcgaggttgtggtggacctggccatgcccatggcagacgggcgagaattcaacctgcgacgtggtgaccgcctcctcctcttccccttcctgagcccccagagagacccagaaatctacacagacccagaggtatttaaatacaaccgattcctgaaccctgacggatcagagaagaaagacttttacaaggatgggaaacggctgaagaattacaacatgccctggggggcggggcacaatcactgcctggggaggagttatgcggtcaacagcatcaaacaatttgtgttccttgtgctggtgcacttggacttggagctgatcaacgcagatgtggagatccctgagtttgacctcagcagcgcctcctggacctgaaggcatctgagtgtgagaccc

SEQ ID NO: 3949 - DNA, 377 bp, Artificial Sequence; identical to SEQ ID NO: 2235
  Synthetic polypeptide

SEQ ID NO: 3950 - DNA, 347 bp, Artificial Sequence; identical to SEQ ID NO: 2236
  Synthetic polypeptide

SEQ ID NO: 3951 - DNA, 658 bp, Artificial Sequence
  Synthetic polypeptide
atgaagcttcttcatgttttcctgttatttctgtgcttccacttaaggttttgcaaggtttcagtagaagatttgagcaggcagaagaaatagtcaacaaacttgaagatcagtccatttaattaattatccagtatgagaagcagaaagaaaaaaggatgacaaggaatgaacagagcctatgagactcgtgtgacaccataaagcataccaaaatatatataatggaaccccagaaggagaaaataagaaagtaagagagaatatatgaagaaataatggctgaaaaatttccacatttgatcaaatgcatggctgtccacattcaaaaagctcaatgcaatccaagaaggataaacacaaaaaggttcaaaccaagacacattataatcaaattgtcaaaaccaaggatgaagaaagtcttgaaaacaacatagtcatgagattccgtaagattagcagcagctttctcatcagaaaccatggagggcagatgaaaattttatttgttgaaagtaaaaaactgtcaaccaagaattctgtatctggcaaaactatccttcacaaatgaaggagaaatgaagaaattcacagataaatagaggctgaaggagttagctactaatagacctgtcctacaggaaatgcactacaagta

SEQ ID NO: 3952 - DNA, 951 bp, Artificial Sequence; identical to SEQ ID NO: 1109
  Synthetic polypeptide

SEQ ID NO: 3953 - DNA, 1036 bp, Artificial Sequence; identical to SEQ ID NO: 1110
  Synthetic polypeptide

SEQ ID NO: 3954 - DNA, 871 bp, Artificial Sequence; identical to SEQ ID NO: 1111
  Synthetic polypeptide

SEQ ID NO: 3955 - DNA, 154 bp, Artificial Sequence; identical to SEQ ID NO: 2227
  Synthetic polypeptide

SEQ ID NO: 3956 - DNA, 951 bp, Artificial Sequence; identical to SEQ ID NO: 1127
  Synthetic polypeptide

SEQ ID NO: 3957 - DNA, 1036 bp, Artificial Sequence; identical to SEQ ID NO: 1128
  Synthetic polypeptide

SEQ ID NO: 3958 - DNA, 871 bp, Artificial Sequence; identical to SEQ ID NO: 1129
  Synthetic polypeptide

SEQ ID NO: 3959 - DNA, 133 bp, Artificial Sequence; identical to SEQ ID NO: 1689
  Synthetic polypeptide

SEQ ID NO: 3960 - DNA, 874 bp, Artificial Sequence; identical to SEQ ID NO: 1690
  Synthetic polypeptide

SEQ ID NO: 3961 - DNA, 961 bp, Artificial Sequence; identical to SEQ ID NO: 1691
  Synthetic polypeptide

SEQ ID NO: 3962 - DNA, 520 bp, Artificial Sequence; identical to SEQ ID NO: 1692
  Synthetic polypeptide

SEQ ID NO: 3963 - DNA, 277 bp, Artificial Sequence; identical to SEQ ID NO: 1693
  Synthetic polypeptide

SEQ ID NO: 3964 - DNA, 465 bp, Artificial Sequence
  Synthetic polypeptide
atggcttgggccgcgctcctcggcctcctggccgcactgttgctgctgctgctactgagccgccgccgcacgcggtgtggtcacatcacttactggctcctgctgcaaaccctccagtggatccctgccacgcgtggcataggagccggactcccaccttggccttggccctcgtggtccacaaagtcatctccagcatcatcgcctacgtctcgtccccacattctccactccagccacgctggctcctgctgtctcgaaaacctcaccgagcatgctcccaccccagtacctttgcacttgctgttgcctctgcctgtaacactcttctccctgcccctcccagagcactcccttcacatccttctggtctttgctcacgtggcatctcctgaggaggccctccttgaccaccttttgtaaaccagcccccctcactgtctcacaccaccctgttttcttttt

SEQ ID NO: 3965 - DNA, 999 bp, Artificial Sequence; identical to SEQ ID NO: 983
  Synthetic polypeptide

SEQ ID NO: 3966 - DNA, 314 bp, Artificial Sequence
  Synthetic polypeptide
atgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatgataaccagatgcaacgtgaagatctagactggaccctggtttgatgaaccagctgtaaaaacacatttctggaacaactggagaaaccggagta

SEQ ID NO: 3967 - DNA, 1157 bp, Artificial Sequence
  Synthetic polypeptide
atgaaggaggggagagggagcttcagcgtggagagaggaccgcggaaggagagagagacagcccagagtggaatgtggaagggaaacagtccagcggggagccagggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcagggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatgataaccagatgcaacgtgaagatctagactggaccctggtttgatgaaccagctgtaaaaacacatttctggaacaactggagaaaccggagta

SEQ ID NO: 3968 - DNA, 1221 bp, Artificial Sequence; identical to SEQ ID NO: 122
  Synthetic polypeptide

SEQ ID NO: 3969 - DNA, 767 bp, Artificial Sequence; identical to SEQ ID NO: 937
  Synthetic polypeptide

SEQ ID NO: 3970 - DNA, 677 bp, Artificial Sequence; identical to SEQ ID NO: 938
  Synthetic polypeptide

SEQ ID NO: 3971 - DNA, 316 bp, Artificial Sequence; identical to SEQ ID NO: 1815
  Synthetic polypeptide

SEQ ID NO: 3972 - DNA, 806 bp, Artificial Sequence; identical to SEQ ID NO: 974
  Synthetic polypeptide

SEQ ID NO: 3973 - DNA, 2867 bp, Artificial Sequence
  Synthetic polypeptide
atggcttcctggacgagcccctggtgggtgctgatagggatggtcttcatgcactctcccctcccgcagaccacagctgagaaatctcctggagcctatttccttcccgagtttgcactttctcctcagggaagttttctggaagacacaacaggggagcagttcctcacttatcgctatgatgaccagacctcaagaaacactcgttcagatgaagacaaagatggcaactgggatgcttggggcgactggagtgactgctcccggacctgtgggggaggagcatcatattctctgcggagatgtttgactggaaggaattgtgaagggcagaacattcggtacaagacatgcagcaatcatgactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcacctaaggtactggatggaactcgttgcaacacggactccttggacatgtgtatcagtggcatctgtcaggcagtgggctgcgatcggcaactgggaagcaatgccaaggaggacaactgtggagtctgtgccggcgatggctccacctgcaggcttgtacggggacaatcaaagtcacacgtttctcctgaaaaaagagaagaaaatgtaattgctgttcctttgggaagtcgaagtgtgagaattacagtgaaaggacctgcccacctctttattgaatcaaaaacacttcaaggaagcaaaggagaacacagctttaacagccccggcgtctttctcgtagaaaacacaacagtggaatttcagaggggctccgagaggcaaacttttaagattccaggacctctgatggctgatttcatcttcaagaccaggtacactgcagccaaagacagcgtggttcagttcttcttttaccagcccatcagtcatcagtggagacaaactgacttctttccctgcactgtgacgtgtggaggaggttatcagctcaattctgctgaatgtgtggatatccgcttgaagagggtagttcctgaccattattgtcactactaccctgaaaatgtaaaaccaaaaccaaaactgaaggaatgcagcatggatccctgcccatcaagtgatggatttaaagagataatgccctatgaccacttccaacctcttcctcgctgggaacataatccttggactgcatgttccgtgtcctgtggaggagggattcagagacggagctttgtgtgtgtagaggaatccatgcatggagagatattgcaggtggaagaatggaagtgcatgtacgcacccaaacccaaggttatgcaaacttgtaatctgtttgattgccccaagtggattgccatggagtggtctcagtgcacagtgacttgtggccgagggttacggtaccgggttgttctgtgtattaaccaccgcggagagcatgttgggggctgcaatccacaactgaagttacacatcaaagaagaatgtgtcattcccatcccgtgttataaaccaaaagaaaaaagtccagtggaagcaaaattgccttggctgaaacaagcacaagaactagaagagaccagaatagcaacagaagaaccaacgttcattccagaaccctggtcagcctgcagtaccacgtgtgggccgggtgtgcaggtccgtgaggtgaagtgccgtgtgctcctcacattcacgcagactgagactgagctgcccgaggaagagtgtgaaggccccaagctgcccaccgaacggccctgcctcctggaagcatgtgatgagagcccggcctcccgagagctagacatccctctccctgaggacagtgagacgacttacgactgggagtacgctgggttcaccccttgcacagcaacatgcgtgggaggccatcaagaagccatagcagtgtgcttacatatccagacccagcagacagtcaatgacagcttgtgtgatatggtccaccgtcctccagccatgagccaggcctgtaacacagagccctgtccccccaggtggcatgtgggctcttgggggccctgctcagctacctgtggagttggaattcagacccgagatgtgtactgcctgcacccaggggagacccctgcccctcctgaggagtgccgagatgaaaagccccatgctttacaagcatgcaatcagtttgactgccctcctggctggcacattgaagaatggcagcagtgttccaggacttgtggcgggggaactcagaacagaagagtcacctgtcggcagctgctaacggatggcagctttttgaatctctcagatgaattgtgccaaggacccaaggcatcgtctcacaagtcctgtgccaggacagactgtcctccacatttagctgtgggagactggtcgaaggagcattcaatgcaagaggacaatggagcaggatctacacaattctaaagaaaagcaagcatgactcaaggatttcctcttcatcctgtgttcttcatgtagagagacagcagagaggcagtcagagaatactgtctgataagcccttgaaaaagctgtagggccaagatgagatacagagatgactcaaaacagagaatccaggaatgcatagatcctggtaaaaaaggtgggagatgagtaataaattcatttgtgtaggattaagactaatcaactaacaattatattatagaacataacataaatatcagaaatcttgacattatctaaataataaaatgaaaactaattgagatttggagagatgaggtaga

SEQ ID NO: 3974 - DNA, 1107 bp, Artificial Sequence
  Synthetic polypeptide
atgttccactgcatccccctgtggcggtgcaaccgtcatgtggagagcatcgacaagcgccactgctcgctggtctacgtccccgaggagatctaccgctatgcccggagcctggaggagctgctgctggacgccaaccagctccgcgagctgcccgagcaatttttccagctagtcaaattacgaaagcttggacttagtgataatgaaattcagcggctccctccagaaatagcaaacttcatgcagctggtggaactagatgtgtctcgaaatgagattcctgaaattccagaaagcatttcattctgtaaagcactgcaggtagctgacttcagcggaaacccactgactaggttgccagaaagctttcctgaattacagaatttaacatgtctttctgtaaatgacatctcactacagtctctacctgaaaatattggcaatctttataacctggcttcactggaactgagagagaatcttcttacatatcttcctgactctcttacccagctgcgaagactagaagaacttgatttaggaaacaatgaaatatataatttgccagaatcaattggagccctcttacatctaaaagatctctggttggatggaaatcaactgtcagaattacctcaggaaataggaaatctgaagaacctgctgtgtttagatgtctctgaaaacaggttggaaagacttcctgaagaaatcagtggcctgacttcattaacggatttagtcatttcccagaacttattagaaacgattccggatggcattggaaaactaaagaaactgtcaatcttgaaggtggatcagaatagactcacacagttgcctgaagcagttggggaatgtgaaagtctcactgagttagttcttacagaaaatcagctcctgaccctgcctaaaagcattggaaaactaaagaagttgagcaacttgaatgcagacagaaataaattagtgtccttaccaaaagagatcggcgggtgctgcagcctcactgtgttctgtgtacgtgacaacagactaactcggatacctgcagaggtgtcacaggcaacagaacttcatgtcctggatgtggcagggaacagg

SEQ ID NO: 3975 - DNA, 117 bp, Artificial Sequence; identical to SEQ ID NO: 928
  Synthetic polypeptide

SEQ ID NO: 3976 - DNA, 51 bp, Artificial Sequence; identical to SEQ ID NO: 929
  Synthetic polypeptide

SEQ ID NO: 3977 - DNA, 816 bp, Artificial Sequence; identical to SEQ ID NO: 2923
  Synthetic polypeptide

SEQ ID NO: 3978 - DNA, 769 bp, Artificial Sequence; identical to SEQ ID NO: 2924
  Synthetic polypeptide

SEQ ID NO: 3979 - DNA, 720 bp, Artificial Sequence; identical to SEQ ID NO: 2925
  Synthetic polypeptide

SEQ ID NO: 3980 - DNA, 169 bp, Artificial Sequence
  Synthetic polypeptide
atgaaccaactcagcttcctgctgtttctcatagcgaccaccagaggatggagtacaggcctttggatatgctgttttccctgccttggattggcttcctactgataaatcatgtttattctctcagaataagctaagatgtcacctggactggaaggtcttctgtgac

SEQ ID NO: 3981 - DNA, 3992 bp, Artificial Sequence; identical to SEQ ID NO: 120
  Synthetic polypeptide

SEQ ID NO: 3982 - DNA, 3845 bp, Artificial Sequence; identical to SEQ ID NO: 121
  Synthetic polypeptide

SEQ ID NO: 3983 - DNA, 4039 bp, Artificial Sequence; identical to SEQ ID NO: 2238
  Synthetic polypeptide

SEQ ID NO: 3984 - DNA, 1587 bp, Artificial Sequence
  Synthetic polypeptide
atgaaagtgaggtcggccggcggcgatggagatgccttgtgcgttacagaagaggacctggcgggtgacgacgaggacatgccgaccttcccatgcacccagaagggccggccagggccccgctgcagccgctgccagaagaacctatctttgcacacatcggtgcggattctttacctcttcctggccctgctcctggtggccgtggctgtgttggcctctctggttttcagaaaagtggactctctctccgaagacatctccttgacccagtctatttatgacaagaagcttgtgttaatgcagaaaaatctccagggcctggatccgaaagccctgaacaactgctctttctgccatgaagctgggcagctggggccagagatccgaaaactgcaggaggagctggagggaattcagaagctgcttctggcccaggaggtgcagctggaccagaccttacaggcccaggaggtgctctccaccaccagcagacaaatctcccaggagatgggcagttgctccttctccatccaccaggttaaccagtctctggggctcttcctggcccaggtgagaggctggcaggccaccacagctggcctggacctctctctgaaggacctcacccaggagtgctacgatgtcaaggctgcagtgcaccagatcaacttcaccgtggggcagacttccgagtggatccacgggatccagcggaagacagacgaggagaccctgaccctccagaagattgtcaccgactggcagaactacacacggctcttcagcggcctgcgcaccacctccaccaagactggagaggcggtcaagaacatccaggccaccctgggggcctcctcacagcgcatcagccagaactcagagagcatgcacgacctggtactccaggtcatgggcttgcagctgcagctggataacatctcgtccttcctggatgaccacgaagagaacatgcatgatcttcagtaccatacccactacgcccagaaccgcactgtggagaggtttgagtctctggaaggacgcatggcttctcacgagattgaaattggcaccatcttcaccaacatcaatgccaccgacaaccacgtgcacagcatgctcaagtacctggatgacgtgcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggaaacagaaacttggatctgcaagaaggagtggagagcagcagaagtggtaaattagaacgtaaatattaaaatgcatggatttttttctctctgaattctcttgagagacaactgactattgtaagggaagattattttaagactattttaagataagactggagattggatttataatgtgtcaagttgatatgacaacaagagcaccagggatag

SEQ ID NO: 3985 - DNA, 200 bp, Artificial Sequence; identical to SEQ ID NO: 3254
  Synthetic polypeptide

SEQ ID NO: 3986 - DNA, 1043 bp, Artificial Sequence; identical to SEQ ID NO: 3255
  Synthetic polypeptide

SEQ ID NO: 3987 - DNA, 1743 bp, Artificial Sequence; identical to SEQ ID NO: 1253
  Synthetic polypeptide

SEQ ID NO: 3988 - DNA, 1518 bp, Artificial Sequence; identical to SEQ ID NO: 1254
  Synthetic polypeptide

SEQ ID NO: 3989 - DNA, 1767 bp, Artificial Sequence; identical to SEQ ID NO: 1255
  Synthetic polypeptide

SEQ ID NO: 3990 - DNA, 4932 bp, Artificial Sequence
  Synthetic polypeptide
atgcccggcggccccagtccccgcagccccgcgcctttgctgcgccccctcctcctgctcctctgcgctctggctcccggcgcccccggacccgcaccaggacgtgcaaccgagggccgggcggcactggacatcgtgcacccggttcgagtcgacgcggggggctccttcctgtcctacgagctgtggccccgcgcactgcgcaagcgggatgtatctgtgcgccgagacgcgcccgccttctacgagctacaataccgcgggcgcgagctgcgcttcaacctgaccgccaatcagcacctgctggcgcccggctttgtgagcgagacgcggcggcgcggcggcctgggccgcgcgcacatccgggcccacaccccggcctgccacctgcttggcgaggtgcaggaccctgagctcgagggtggcctggcggccatcagcgcctgcgacggcctgaaaggtgtgttccagctctccaacgaggactacttcattgagcccctggacagtgccccggcccggcctggccacgcccagccccatgtggtgtacaagcgtcaggccccggagaggctggcacagcggggtgattccagtgctccaagcacctgtggagtgcaagtgtacccagagctggagtctcgacgggagcgttgggagcagcggcagcagtggcggcggccacggctgaggcgtctacaccagcggtcggtcagcaaagagaagtgggtggagaccctggtagtagctgatgccaaaatggtggagtaccacggacagccgcaggttgagagctatgtgctgaccatcatgaacatggtggctggcctgtttcatgaccccagcattgggaaccccatccacatcaccattgtgcgcctggtcctgctggaagatgaggaggaggacctaaagatcacgcaccatgcagacaacaccctgaagagcttctgcaagtggcagaaaagcatcaacatgaagggggatgcccatcccctgcaccatgacactgccatcctgctcaccagaaaggacctgtgtgcagccatgaaccggccctgtgagaccctgggactgtcccatgtggcgggcatgtgccagccgcaccgcagctgcagcatcaacgaggacacgggcctgccgctggccttcactgtagcccacgagctcgggcacagttttggcattcagcatgacggaagcggcaatgactgtgagcccgttgggaaacgacctttcatcatgtctccacagctcctgtacgacgccgctcccctcacctggtcccgctgcagccgccagtatatcaccaggttccttgaccgtgggtggggcctgtgcctggacgaccctcctgccaaggacattatcgacttcccctcggtgccacctggcgtcctctatgatgtaagccaccagtgccgcctccagtacggggcctactctgccttctgcgaggacatggataatgtctgccacacactctggtgctctgtggggaccacctgtcactccaagctggatgcagctgtggacggcacccggtgtggggagaataagtggtgtctcagtggggagtgcgtacccgtgggcttccggcccgaggccgtggatggtggctggtctggctggagcgcctggtccatctgctcacggagctgtggcatgggcgtacagagcgccgagcggcagtgcacgcagcctacgcccaaatacaaaggcagatactgtgtgggtgagcgcaagcgcttccgcctctgcaacctgcaggcctgccctgctggccgcccctccttccgccacgtccagtgcagccactttgacgctatgctctacaagggccagctgcacacatgggtgcccgtggtcaatgacgtgaacccctgcgagctgcactgccggcccgcgaatgagtactttgccgagaagctgcgggacgccgtggtcgatggcaccccctgctaccaggtccgagccagccgggacctctgcatcaacggcatctgtaagaacgtgggctgtgacttcgagattgactccggtgctatggaggaccgctgtggtgtgtgccacggcaacggctccacctgccacaccgtgagcgggaccttcgaggaggccgagggcctggggtatgtggatgtggggctgatcccagcgggcgcacgcgagatccgcatccaagaggttgccgaggctgccaacttcctggcactgcggagcgaggacccggagaagtacttcctcaatggtggctggaccatccagtggaacggggactaccaggtggcagggaccaccttcacatacgcacgcaggggcaactgggagaacctcacgtccccgggtcccaccaaggagcctgtctggatccagctgctgttccaggagagcaaccctggggtgcactacgagtacaccatccacagggaggcaggtggccacgacgaggtcccgccgcccgtgttctcctggcattatgggccctggaccaagtgcacagtcacctgcggcagaggtgtgcagaggcagaatgtgtactgcttggagcggcaggcagggcccgtggacgaggagcactgtgaccccctgggccggcctgatgaccaacagaggaagtgcagcgagcagccctgccctgccaggtggtgggcaggtgagtggcagctgtgctccagctcctgcgggcctgggggcctctcccgccgggccgtgctctgcatccgcagcgtggggctggatgagcagagcgccctggagccacccgcctgtgaacaccttccccggccccctactgaaaccccttgcaaccgccatgtaccctgtccggccacctgggctgtggggaactggtctcagtgctcagtgacatgtggggagggcactcagcgccgaaatgtcctctgcaccaatgacaccggtgtcccctgtgacgaggcccagcagccagccagcgaagtcacctgctctctgccactctgtcggtggcccctgggcacactgggccctgaaggctcaggcagcggctcctccagccacgagctcttcaacgaggctgacttcatcccgcaccacctggccccacgcccttcacccgcctcatcacccaagccaggcaccatgggcaacgccattgaggaggaggctccagagctggacctgccggggcccgtgtttgtggacgacttctactacgactacaatttcatcaatttccacgaggatctgtcctacgggccctctgaggagcccgatctagacctggcggggacaggggaccggacacccccaccacacagccatcctgctgcgccctccacgggtagccccgtgcctgccacagagcctcctgcagccaaggaggagggggtactgggaccttggtccccgagcccttggcctagccaggccggccgctccccacccccaccctcagagcagacccctgggaaccctttgatcaatttcctgcctgaggaagacacccccataggggccccagatcttgggctccccagcctgtcctggcccagggtttccactgatggcctgcagacacctgccacccctgagagccaaaatgatttcccagttggcaaggacagccagagccagctgccccctccatggcgggacaggaccaatgaggttttcaaggatgatgaggaacccaagggccgaggagcaccccacctgcccccgagacccagctccacgctgccccctttgtcccctgttggcagcacccactcctctcctagtcctgacgtggcggagctgtggacaggaggcacagtggcctgggagccagctctggagggtggcctggggcctgtggacagtgaactgtggcccactgttggggtggcttctctccttcctcctcccatagcccctctgccagagatgaaggtcagggacagttccctggagccggggactccctccttcccaaccccaggaccaggctcatgggacctgcagactgtggcagtgtgggggaccttcctccccacaaccctgactggcctcgggcacatgcctgagcctgccctgaacccaggacccaagggtcagcctgagtccctcagccctgaggtgcccctgagctctaggctgctgtccacaccagcttgggacagccccgccaacagccacagagtccctgagacccagccgctggctcccagcctggctgaagcggggccccccgcggacccgttggttgtcaggaacgccggctggcaagcgggaaactggagcgagtgctctaccacctgtggcctgggtgcggtctggaggccggtgcgctgtagctccggccgggatgaggactgcgcccccgctggccggccccagcctgcccgccgctgccacctgcggccctgtgccacctggcactcaggcaactggagtaagtgctcccgcagctgcggcggaggttcctcagtgcgggacgtgcagtgtgtggacacacgggacctccggccactgcggcccttccattgtcagcccgggcctgccaagccgcctgcgcaccggccctgcggggcccagccctgcctcagctggtacacatcttcctggagggagtgctccgaggcctgtggcggtggtgagcagcagcgtctagtgacctgcccggagccaggcctctgcgaggaggcgctgagacccaacaccacccggccctgcaacacccacccctgcacgcagtgggtggtggggccctggggccagtgctcaggcccctgtggtggtggtgtccagcggcgcctggtcaagtgtgtcaacacccagacagggctgcccgaggaagacagtgaccagtgtggccacgaggcctggcctgagagctcccggccgtgtggcaccgaggattgtgagcccgtcgagcctccccgtctcagtcttcccacagtgagaccaggg

SEQ ID NO: 3991 - DNA, 5237 bp, Artificial Sequence
  Synthetic polypeptide
atgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccagtgggaggccagcttggctctacagcatgccagtgaggccctgttgacagtgagtgccaaggcccgccctgaggaccagaggcgccaggcagccaccagggacctgtttcaggctgtgggcagtgtgctggaagcttccctgagcaacagaccagaagagcctgcggaggccagcagcagccagattgccacagtgctgcggctgcttcgagtcatggagcatgtgcagaccaccctcctgctgggaaaactgccagggggccttccagccatgctggccaccccctccatctctgtgtacacaaacagaatacaaccctggagttggcaaggctcctccctgcgccctgatgccgcagactctgcaaccttcatgctgcccgctgcctcctccctcagctctctggagggcggccaggagcccgtggatataaagatcatgagtttcccaaagagcccctttccagcccgaagccactttgatgtcagcgggactgtcggtggcctccgtgtgaccagccctagtggtcaactcatacctgtgaagaatctgtcggagaatatcgagatcctgctgccccggcattcacaaagacacagccagccgaccgtgttgaacctgaccagtcctgaagctttgtgggtgaacgtgacttcaggggaggcaaccttggggatccagctgcactggagaccagacattgcactcacgcttagcctgggctatggctaccaccccaacaagagcagctacgatgcccaaactcacctcgtaccaatggtggctccagatgagctgcccacgtggatcctgagcccacaggacctgcgttttggagaaggggtctactatttgactgtggtccctgagtctgacctggagccagcccccggcagggacctcacggttggcatcaccaccttcctgtctcactgtgtgttctgggatgaggtccaggagacttgggacgactcaggatgccaggtggggcctcggaccagcccctaccagacacactgcctctgcaaccacctcactttcttcggaagcacgttcctggtgatgtccaatgccatcaacatccaccagactgctgagctctttgccacctttgaggacaaccctgtggtcgtgaccaccgtgggctgcctgtgtgtggtctacgtgctggtggtgatctgggcgaggaggaaggacgctcaggatcaggccaaggtgaaggtcacagtgctggaagacaatgatccctttgctcagtaccactacctggtgacagtctacacaggacaccgacgaggggcagccacgtcctcaaaggtgactgtcaccctgtatggcctggatggagagagagagccccaccacctggctgatcccgacactccggtttttgagcgaggagcagtggatgccttcctcctctccaccctgttccccctgggagaactgcggagcctccggctgtggcatgacaactcaggggaccggccatcgtggtatgtgagccgggtgctggtctatgacctggtgatggaccggaagtggtatttcctgtgcaactcctggctatccatcaatgttggagattgcgtcctcgataaggtgtttcctgtggccacggagcaggacagaaaacaattcagccacctgtttttcatgaagacttccgcgggcttccaggatggacacatctggtattcgatcttcagccgctgcgctcgcagcagcttcacccgcgtccagagggtgtcctgctgcttctccctgctgctgtgcaccatgctgaccagcatcatgttctggggggtccccaaggacccagctgagcaaaagatggacttgggtaaaattgaattcacctggcaggaggtgatgattggcctggagagctccatcctcatgttccccatcaacctcctgattgttcagatctttcagaacacccgtccccgggtcgcgaaggagcagaacactggaaaatgggaccgggggtcccccaacctgactccctccccacagcccatggaggacggccttctgacacctgaggcagtgaccaaggatgtgtcaagaatcgtcagctccctcttcaaagctctcaaggtgccatcccccgccttgggctgggactcagtgaacttgatggacatcaacagtctcctcgccttggtggaagatgtcatttatccacagaacacatcagggcaggtgttctgggaggaagccaaaaagagagaggaccctgtaacactcactttggggtcatcagaaatgaaagagaaatcacagtgtcccaagcccaaggcggcacggagtggcccctggaaggacagcgcctacaggcagtgtctgtaccttcagctggaacacgtggagcaagagctgcggctggtggggccccgaggcttctcccagccccacagccatgcctaggccctcaggcagctgcagaccctgaagggcggcctgggggtacagccgggcacctgggcccctgcacatgccagcgctcttcaggtgagcaaaccccctcaaggcctgccctggtggtgcatcctggtgggctggctcctggtagcggccaccagtggcgtggcggccttcttcaccatgctctacggcctgcactacgggagggccagctccctcaggtggctcatctccatggctgtctccttcgtggagagcatgttcgtcacccagcccctgaaggtgctgggattcgctgctttctttgcactggtcttgaagagagtggacgatgaggaggatactgtggccccgctgccaggacatctgttgggcccagacccctatgccttgttccgagcacgaagaaacagcagcagggatgtctaccagccacctctcaccgctgccattgagaagatgaaaaccacccacctcaaggaacagaaagcatttgccctcatcagagaaatcctggcatacttgggcttcctgtggatgctactgctcgtggcctacgggcagagggaccccagcgcctaccacctcaacagacacctccagcacagcttcaccaggggcttttcaggtgtgctcggcttccgagagttcttcaagtgggccaacaccaccctcgtgagtaacctgtatggtcaccccccaggctttatcactgatgggaactccaagctggttggcagtgcccagattcgtcaagtgagggtccaggaaagctcttgccctcttgcccagcagccgcaggcatatctcaacggatgccgtgcaccatattccctggatgctgaagacatggcagactatggggaaggctggaatgccaccaccctcagtaatggcagtaccagagccaggaccaacgtcaagggtatcccatctggggcaaactcactgtgtaccggggaggaggctacgtggtccccttggggactgatcgccaaagcacgtcaagaattctccgctatctctttgacaacacctggctggacgccctgaccagagctgtgtttgtggagtccactgtctacaacgccaacgtcaacctgttctgcattgtcacgctgacgctagagaccagcgctctgggcaccttttttacgcacgcggccctgcagagcctccgcctgtaccccttcaccgacggctggcaccccttcgtggtagcggcagagctcatctacttcctcttcctcctctactacatggtggtgcagggcaagcgcatgagtaaagagacgtggggctatttctgcagcaagtggaaccttctggagctggccatcatcctggccagctggagcgccctggcggtgtttgtgaagagggctgtcctggccgaaagggacctccagcgctgccggaaccacagggaggaaggcatcagcttcagtgagacagcagcagccgatgccgcccttggctacatcattgccttcctggtactcctgtccacagtgaagctttggcatctgctcaggttgaatcccaaaatgaacatgatcacggcagccctacgccgtgcctggggcgacatttcaggctttatgattgtcatccttaccatgctcctggcttactccatcgcgtcaaacttgatatttggttggaaactccgttcctacaaaaccctctttgatgcggcggagacgatggtcagccttcagctgggaatcttcaactacgaggaggtcctggactatagcccagtgcttggctccttcctcattggatcctgcattgtttttatgacatttgtggtgctgaacctgtttatctctgtcatcctggtggccttcagtgaggagcaaaaatactatcagtgacctccaccctgagtgcaccttagaatcacctggggccttttggaaacaacggctgcccagccagagaccaat

SEQ ID NO: 3992 - DNA, 7292 bp, Artificial Sequence
  Synthetic polypeptide
atgagtgcagtgggcttggtactcctggtgcttgctctgaggcttagggccaccactgttaagccagaggaaggcagcttttgctctaacagccaggtggccttcagagatgcttgctatgaatttgtgccactcggacgcaccttccgtgatgcccagagctggtgcgaggggcaaggaggccatttggtcttcattcaggacgaaggcacccagtggtttctgcagaagcacatctcccaggacagggaatggtggattggactcacgtggaacttggcacggaatggaaccacggaggggccggggacttggttggacacctccaatgtgacctacagcaactggcatggagggcaggccgccgctgcccctgacacctgcggccacatcgggagaggcccttcctctgagtgggtgacctcggactgcgcccagaccttcgccttcatgtgcgagttccgggttggccagagcctggcctgcgagggactcaatgccaccgtgcactgtggcttggggcaggtcatccaggtccaggatgccgtctacgggcgccagaatccccatttctgcacccaggatgccgggcgtccttcagatctggagcagggatgcagctgggccaacgtcaaggaggaggtggcaggccagtgccaggagctacagtcatgccaggtggcagcagatgagacctactttggaaacctgtgtccgactcagggcagttacctgtgggtgcagtaccagtgccgggaagccctgcagctgatggtgtccagtgagagtttcatctttgacaatgtcaccatctccctgacgtggctcctctcaccctacataggaaacctgtcctgtataattagtacaggagacagccacacttttgatccctacaacccgccgagtgtgtccagcaatgtgacccaccagttcacatctcctggggaattcaccgtgtttgctgaatgcacaaccagtgagtggcatgtgacagctcagaggcaggtgaccgtgcgagacaagatggagacgctcagtgtgactgcatgctccggcctgtcccagtcaggagccggccctctctgccaggctgtctttggggatcctctgtggattcaggtggagcttgatggaggaacaggagtgacttacactgtgcttttgggtgacataaccctggccgagtccaccacccaaaagggctcgctaccgtacaatctgatcctggacagagaaacccagaaactgatgggccctgggaggcaccgcctggagatccaagccaccggcaacaccaccacctctacaatctccagaaacattacagtccacttggtggagctgctgtcagggctgcaggcctcctgggcttctgaccatttggagcttggacaggacctattgatcaccatctcattggctcagggcaccccggaagagctgacctttgaggtggctggactcaatgcaaccttctcccacgagcaagtgagctttggagagccatttgggatttgccgcctggctgttccggttgaaggcacctttctggtcaccatgctggtgaggaatgccttctccaacctgagtttggaaatcgggaacatcactatcacagccccttccggtctccaagaaccatctgggatgaatgctgaaggaaagagtaaagataaaggcgatatggaggtgtacatccaacctggtccatatgtggatcctttcacgacagtgaccctgggctggccagacaatgacaaggagttacgcttccaatggtcatgtgggtcttgctgggctctgtggagcagctgtgttgagaggcagctgcttcgcacagaccagagggagctggtggttccagcatcctgcctgccgccgcctgactctgctgtcaccctgcgcctggctgttctgagaggccaagagctggagaacagggcagagcagtgcctctacgtgtctgcgccctgggaactcaggcctcgagtcagctgtgagaggaactgcaggccagttaatgccagcaaagacattctgctcagggtcaccatgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccagtgggaggccagcttggctctacagcatgccagtgaggccctgttgacagtgagtgccaaggcccgccctgaggaccagaggcgccaggcagccaccagggacctgtttcaggctgtgggcagtgtgctggaagcttccctgagcaacagaccagaagagcctgcggaggccagcagcagccagattgccacagtgctgcggctgcttcgagtcatggagcatgtgcagaccaccctcctgctgggaaaactgccagggggccttccagccatgctggccaccccctccatctctgtgtacacaaacagaatacaaccctggagttggcaaggctcctccctgcgccctgatgccgcagactctgcaaccttcatgctgcccgctgcctcctccctcagctctctggagggcggccaggagcccgtggatataaagatcatgagtttcccaaagagcccctttccagcccgaagccactttgatgtcagcgggactgtcggtggcctccgtgtgaccagccctagtggtcaactcatacctgtgaagaatctgtcggagaatatcgagatcctgctgccccggcattcacaaagacacagccagccgaccgtgttgaacctgaccagtcctgaagctttgtgggtgaacgtgacttcaggggaggcaaccttggggatccagctgcactggagaccagacattgcactcacgcttagcctgggctatggctaccaccccaacaagagcagctacgatgcccaaactcacctcgtaccaatggtggctccagatgagctgcccacgtggatcctgagcccacaggacctgcgttttggagaaggggtctactatttgactgtggtccctgagtctgacctggagccagcccccggcagggacctcacggttggcatcaccaccttcctgtctcactgtgtgttctgggatgaggtccaggagacttgggacgactcaggatgccaggtggggcctcggaccagcccctaccagacacactgcctctgcaaccacctcactttcttcggaagcacgttcctggtgatgtccaatgccatcaacatccaccagactgctgagctctttgccacctttgaggacaaccctgtggtcgtgaccaccgtgggctgcctgtgtgtggtctacgtgctggtggtgatctgggcgaggaggaaggacgctcaggatcaggccaaggtgaaggtcacagtgctggaagacaatgatccctttgctcagtaccactacctggtgacagtctacacaggacaccgacgaggggcagccacgtcctcaaaggtgactgtcaccctgtatggcctggatggagagagagagccccaccacctggctgatcccgacactccggtttttgagcgaggagcagtggatgccttcctcctctccaccctgttccccctgggagaactgcggagcctccggctgtggcatgacaactcaggggaccggccatcgtggtatgtgagccgggtgctggtctatgacctggtgatggaccggaagtggtatttcctgtgcaactcctggctatccatcaatgttggagattgcgtcctcgataaggtgtttcctgtggccacggagcaggacagaaaacaattcagccacctgtttttcatgaagacttccgcgggcttccaggatggacacatctggtattcgatcttcagccgctgcgctcgcagcagcttcacccgcgtccagagggtgtcctgctgcttctccctgctgctgtgcaccatgctgaccagcatcatgttctggggggtccccaaggacccagctgagcaaaagatggacttgggtaaaattgaattcacctggcaggaggtgatgattggcctggagagctccatcctcatgttccccatcaacctcctgattgttcagatctttcagaacacccgtccccgggtcgcgaaggagcagaacactggaaaatgggaccgggggtcccccaacctgactccctccccacagcccatggaggacggccttctgacacctgaggcagtgaccaaggatgtgtcaagaatcgtcagctccctcttcaaagctctcaaggtgccatcccccgccttgggctgggactcagtgaacttgatggacatcaacagtctcctcgccttggtggaagatgtcatttatccacagaacacatcagggcaggtgttctgggaggaagccaaaaagagagaggaccctgtaacactcactttggggtcatcagaaatgaaagagaaatcacagtgtcccaagcccaaggcggcacggagtggcccctggaaggacagcgcctacaggcagtgtctgtaccttcagctggaacacgtggagcaagagctgcggctggtggggccccgaggcttctcccagccccacagccatgcctaggccctcaggcagctgcagaccctgaagggcggcctgggggtacagccgggcacctgggcccctgcacatgccagcgctcttcaggtgagcaaaccccctcaaggcctgccctggtggtgcatcctggtgggctggctcctggtagcggccaccagtggcgtggcggccttcttcaccatgctctacggcctgcactacgggagggccagctccctcaggtggctcatctccatggctgtctccttcgtggagagcatgttcgtcacccagcccctgaaggtgctgggattcgctgctttctttgcactggtcttgaagagagtggacgatgaggaggatactgtggccccgctgccaggacatctgttgggcccagacccctatgccttgttccgagcacgaagaaacagcagcagggatgtctaccagccacctctcaccgctgccattgagaagatgaaaaccacccacctcaaggaacagaaagcatttgccctcatcagagaaatcctggcatacttgggcttcctgtggatgctactgctcgtggcctacgggcagagggaccccagcgcctaccacctcaacagacacctccagcacagcttcaccaggggcttttcaggtgtgctcggcttccgagagttcttcaagtgggccaacaccaccctcgtgagtaacctgtatggtcaccccccaggctttatcactgatgggaactccaagctggttggcagtgcccagattcgtcaagtgagggtccaggaaagctcttgccctcttgcccagcagccgcaggcatatctcaacggatgccgtgcaccatattccctggatgctgaagacatggcagactatggggaaggctggaatgccaccaccctcagtaatggcagtaccagagccaggaccaacgtcaagggtatcccatctggggcaaactcactgtgtaccggggaggaggctacgtggtccccttggggactgatcgccaaagcacgtcaagaattctccgctatctctttgacaacacctggctggacgccctgaccagagctgtgtttgtggagtccactgtctacaacgccaacgtcaacctgttctgcattgtcacgctgacgctagagaccagcgctctgggcaccttttttacgcacgcggccctgcagagcctccgcctgtaccccttcaccgacggctggcaccccttcgtggtagcggcagagctcatctacttcctcttcctcctctactacatggtggtgcagggcaagcgcatgagtaaagagacgtggggctatttctgcagcaagtggaaccttctggagctggccatcatcctggccagctggagcgccctggcggtgtttgtgaagagggctgtcctggccgaaagggacctccagcgctgccggaaccacagggaggaaggcatcagcttcagtgagacagcagcagccgatgccgcccttggctacatcattgccttcctggtactcctgtccacagtgaagctttggcatctgctcaggttgaatcccaaaatgaacatgatcacggcagccctacgccgtgcctggggcgacatttcaggctttatgattgtcatccttaccatgctcctggcttactccatcgcgtcaaacttgatatttggttggaaactccgttcctacaaaaccctctttgatgcggcggagacgatggtcagccttcagctgggaatcttcaactacgaggaggtcctggactatagcccagtgcttggctccttcctcattggatcctgcattgtttttatgacatttgtggtgctgaacctgtttatctctgtcatcctggtggccttcagtgaggagcaaaaatactatcagtgacctccaccctgagtgcaccttagaatcacctggggccttttggaaacaacggctgcccagccagagaccaat

SEQ ID NO: 3993 - DNA, 235 bp, Artificial Sequence; identical to SEQ ID NO: 1657
  Synthetic polypeptide

SEQ ID NO: 3994 - DNA, 1078 bp, Artificial Sequence; identical to SEQ ID NO: 1658
  Synthetic polypeptide

SEQ ID NO: 3995 - DNA, 303 bp, Artificial Sequence; identical to SEQ ID NO: 148
  Synthetic polypeptide

SEQ ID NO: 3996 - DNA, 301 bp, Artificial Sequence; identical to SEQ ID NO: 147
  Synthetic polypeptide

SEQ ID NO: 3997 - DNA, 1052 bp, Artificial Sequence; identical to SEQ ID NO: 247
  Synthetic polypeptide

SEQ ID NO: 3998 - DNA, 327 bp, Artificial Sequence; identical to SEQ ID NO: 246
  Synthetic polypeptide

SEQ ID NO: 3999 - DNA, 1284 bp, Artificial Sequence; identical to SEQ ID NO: 2536
  Synthetic polypeptide

SEQ ID NO: 4000 - DNA, 1576 bp, Artificial Sequence
  Synthetic polypeptide
atggcagcggccgccagccccgcgttccttctacgcctcccgcttctgctcctgctgtccagctggtgcaggaccgggctggccgaccctcactctctttgctatgacatcaccgtcatccctaagttcagacctggaccacggtggtgtgcggttcaaggccaggtggatgaaaagacttttcttcactatgactgtggcagcaagacagtcacacccgtcagtcccctggggaagaaactaaatgtcacaacggcctggaaagcacagaacccagtactgagagaggtggtggacatacttacagagcaactgcttgacattcagctggagaattacatacccaaggaacccctcaccctgcaggccaggatgtcttgtgagcagaaagccgaaggacacggcagtggatcttggcagctcagtttcgatggacagatcttcctcctctttgactcagaaaacagaatgtggacaacggttcatcctggagccagaaagatgaaagaaaagtgggagaatgacaaggatatgaccatgtccttccattacatctcaatgggagactgcacaggatggcttgaggacttcttgatgggcatggacagcaccctggagccaagtgcaggagcaccacccaccatgtcctcaggcacagcccaacccagggccacggccaccaccctcatcctttgctgcctcctcatcatgtgtctcctcatatgctccaggcacagtctgacccaaagccatggccaccaccctcagtccctgcagcctcctcctcatcctcccctgcttcatcctacctggctgctgaggagagtcctttggagtgacaggaaaaaccaggccatgcagagacaggagctgaagggacacggtgagaagtgaccagaagacaagagtgtgagccctctgtcatgcccagacagggccagtagtgggctcctcagtctagcagtagcgccagtgcctgggaaggcacttgttacttagcagaccgggaaaaggagtttccctttccccgggggagttagagaagactctgctccaccacctcttgtggaaggcctgacatcagtcaagcctgcccgcagccatccggaggcctaaacgtctccctgtgatgctgtgcttcagggtcacgctcctggtccactttcatgttccgccctgtacacctggctccgccttctagatagcggtagcagaattagtgaaagtattgaagtccgagaaatacatagaagaaacaatgacgtaagctgtcctctctctctccgcctcagctaccaaatagcgaagcgccccttgtctggtggacacgtgactcgcgtgactttacctatcattggagacgactcacactccttaccctgccctcttgccttgtatacaataaataacggcgcagccaggtattcggagccactacaggtctccatatcttgatggttccctgggcccagctgtcttttcttccgtctctttgtcttgtgtctttatttctacgatctctcatctccgcacacgaagagaaaaacccacaggccctgtagggctggtccctaca

SEQ ID NO: 4001 - DNA, 219 bp, Artificial Sequence
  Synthetic polypeptide
atggcctggtggaaatcctggaagaatgaataaacagactaggttgaatccatacaatggaatgttagcagacaataaaaagaaaatgaactactgatgccccctactgcacagcagaagctctgaatcgtgttcctgaatgaaagaagtcaggtatgaaagaataaacattgtatgattccatttatatgaaaatgaatctgtgatttaaaaatcaga

SEQ ID NO: 4002 - DNA, 154 bp, Artificial Sequence; identical to SEQ ID NO: 2227
  Synthetic polypeptide

SEQ ID NO: 4003 - DNA, 1838 bp, Artificial Sequence; identical to SEQ ID NO: 2152
  Synthetic polypeptide

SEQ ID NO: 4004 - DNA, 1146 bp, Artificial Sequence; identical to SEQ ID NO: 988
  Synthetic polypeptide

SEQ ID NO: 4005 - DNA, 1058 bp, Artificial Sequence; identical to SEQ ID NO: 1966
  Synthetic polypeptide

SEQ ID NO: 4006 - DNA, 1273 bp, Artificial Sequence; identical to SEQ ID NO: 1927
  Synthetic polypeptide

SEQ ID NO: 4007 - DNA, 1516 bp, Artificial Sequence; identical to SEQ ID NO: 1928
  Synthetic polypeptide

SEQ ID NO: 4008 - DNA, 1393 bp, Artificial Sequence; identical to SEQ ID NO: 1929
  Synthetic polypeptide

SEQ ID NO: 4009 - DNA, 117 bp, Artificial Sequence; identical to SEQ ID NO: 928
  Synthetic polypeptide

SEQ ID NO: 4010 - DNA, 51 bp, Artificial Sequence; identical to SEQ ID NO: 929
  Synthetic polypeptide

SEQ ID NO: 4011 - DNA, 128 bp, Artificial Sequence; identical to SEQ ID NO: 144
  Synthetic polypeptide

SEQ ID NO: 4012 - DNA, 458 bp, Artificial Sequence
  Synthetic polypeptide
cccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4013 - DNA, 467 bp, Artificial Sequence
  Synthetic polypeptide
acatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4014 - DNA, 7473 bp, Artificial Sequence
  Synthetic polypeptide
atgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4015 - DNA, 7305 bp, Artificial Sequence
  Synthetic polypeptide
atgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4016 - DNA, 7494 bp, Artificial Sequence
  Synthetic polypeptide
atgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatcgtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4017 - DNA, 7308 bp, Artificial Sequence
  Synthetic polypeptide
atgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4018 - DNA, 6156 bp, Artificial Sequence
  Synthetic polypeptide
atgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4019 - DNA, 7443 bp, Artificial Sequence
  Synthetic polypeptide
atgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4020 - DNA, 863 bp, Artificial Sequence
  Synthetic polypeptide
tgactctgggcccccccacttgcctgcaggaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4021 - DNA, 190 bp, Artificial Sequence; identical to SEQ ID NO: 1996
  Synthetic polypeptide

SEQ ID NO: 4022 - DNA, 1563 bp, Artificial Sequence; identical to SEQ ID NO: 2008
  Synthetic polypeptide

SEQ ID NO: 4023 - DNA, 775 bp, Artificial Sequence; identical to SEQ ID NO: 1985
  Synthetic polypeptide

SEQ ID NO: 4024 - DNA, 1845 bp, Artificial Sequence
  Synthetic polypeptide
atgggcatggccaggggcagcctcactcgggttccaggggtgatgggagagggcactcagggcccagagctcagccttgaccctgacccttgctctccccaatccactccggggctcatgaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctggggccgggcgcggtggctcacgcctgtaatcccagcactttgggaggccacggcgggcggatcacgaggtcaggagatggagaccatcctggctaacacggtgaaaccccgtctctactaaaaatacaaaaaattagccgggcgaggtggcgggcgcctgtagtcccagctacgtgggaggctgaggcaggagaatggtgtggacccgggaggcggagcctgcagtgagctgagatcacgccattgcactccagcctgggtgacagcgagactcggtctcaaaaaaaaataaataaataaaataaataaa

SEQ ID NO: 4025 - DNA, 1668 bp, Artificial Sequence
  Synthetic polypeptide
atggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctggggccgggcgcggtggctcacgcctgtaatcccagcactttgggaggccacggcgggcggatcacgaggtcaggagatggagaccatcctggctaacacggtgaaaccccgtctctactaaaaatacaaaaaattagccgggcgaggtggcgggcgcctgtagtcccagctacgtgggaggctgaggcaggagaatggtgtggacccgggaggcggagcctgcagtgagctgagatcacgccattgcactccagcctgggtgacagcgagactcggtctcaaaaaaaaataaataaataaaataaataaa

SEQ ID NO: 4026 - DNA, 768 bp, Artificial Sequence
  Synthetic polypeptide
atgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctggggccgggcgcggtggctcacgcctgtaatcccagcactttgggaggccacggcgggcggatcacgaggtcaggagatggagaccatcctggctaacacggtgaaaccccgtctctactaaaaatacaaaaaattagccgggcgaggtggcgggcgcctgtagtcccagctacgtgggaggctgaggcaggagaatggtgtggacccgggaggcggagcctgcagtgagctgagatcacgccattgcactccagcctgggtgacagcgagactcggtctcaaaaaaaaataaataaataaaataaataaa

SEQ ID NO: 4027 - DNA, 1737 bp, Artificial Sequence
  Synthetic polypeptide
atgagcagtatcaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctggggccgggcgcggtggctcacgcctgtaatcccagcactttgggaggccacggcgggcggatcacgaggtcaggagatggagaccatcctggctaacacggtgaaaccccgtctctactaaaaatacaaaaaattagccgggcgaggtggcgggcgcctgtagtcccagctacgtgggaggctgaggcaggagaatggtgtggacccgggaggcggagcctgcagtgagctgagatcacgccattgcactccagcctgggtgacagcgagactcggtctcaaaaaaaaataaataaataaaataaataaa

SEQ ID NO: 4028 - DNA, 1663 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgggg

SEQ ID NO: 4029 - DNA, 445 bp, Artificial Sequence
  Synthetic polypeptide
atgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaaggcttggcacacagcaggctttcaagaagtgccagttgatcaatgaataaat

SEQ ID NO: 4030 - DNA, 385 bp, Artificial Sequence; identical to SEQ ID NO: 1938
  Synthetic polypeptide

SEQ ID NO: 4031 - DNA, 696 bp, Artificial Sequence; identical to SEQ ID NO: 2305
  Synthetic polypeptide

SEQ ID NO: 4032 - DNA, 323 bp, Artificial Sequence
  Synthetic polypeptide
atggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctggtggccgaggcgcggcggcccgcgcccttcgaagtggtcttcgtgtcagccgacggcagctcccaggagatgctggacttcatgcgcgagctgcatggcgcctggctggcgctgcccttccacgacccctaccggcacagccggagccaactaataca

SEQ ID NO: 4033 - DNA, 692 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatacaaaaattagctgggtgtgttggtgtgcaactgtaatcccagctgctcgggaggctgagacaggagaatcactcgaacccagaaggcagaggctacagtgagctaagatcacaccactgcactccagcctgggccacagagcaatactccgtctcaaaaaaaaaaaaaaaaagaagaagaaaaga

SEQ ID NO: 4034 - DNA, 629 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttgtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatacaaaaattagctgggtgtgttggtgtgcaactgtaatcccagctgctcgggaggctgagacaggagaatcactcgaacccagaaggcagaggctacagtgagctaagatcacaccactgcactccagcctgggccacagagcaatactccgtctcaaaaaaaaaaaaaaaaagaagaagaaaaga

SEQ ID NO: 4035 - DNA, 534 bp, Artificial Sequence; identical to SEQ ID NO: 2415
  Synthetic polypeptide

SEQ ID NO: 4036 - DNA, 542 bp, Artificial Sequence; identical to SEQ ID NO: 2416
  Synthetic polypeptide

SEQ ID NO: 4037 - DNA, 1403 bp, Artificial Sequence; identical to SEQ ID NO: 2417
  Synthetic polypeptide

SEQ ID NO: 4038 - DNA, 491 bp, Artificial Sequence; identical to SEQ ID NO: 2418
  Synthetic polypeptide

SEQ ID NO: 4039 - DNA, 578 bp, Artificial Sequence; identical to SEQ ID NO: 2419
  Synthetic polypeptide

SEQ ID NO: 4040 - DNA, 1280 bp, Artificial Sequence; identical to SEQ ID NO: 2420
  Synthetic polypeptide

SEQ ID NO: 4041 - DNA, 1370 bp, Artificial Sequence; identical to SEQ ID NO: 2421
  Synthetic polypeptide

SEQ ID NO: 4042 - DNA, 692 bp, Artificial Sequence; identical to SEQ ID NO: 2422
  Synthetic polypeptide

SEQ ID NO: 4043 - DNA, 431 bp, Artificial Sequence; identical to SEQ ID NO: 2423
  Synthetic polypeptide

SEQ ID NO: 4044 - DNA, 344 bp, Artificial Sequence; identical to SEQ ID NO: 2424
  Synthetic polypeptide

SEQ ID NO: 4045 - DNA, 1553 bp, Artificial Sequence; identical to SEQ ID NO: 2425
  Synthetic polypeptide

SEQ ID NO: 4046 - DNA, 1493 bp, Artificial Sequence; identical to SEQ ID NO: 2426
  Synthetic polypeptide

SEQ ID NO: 4047 - DNA, 638 bp, Artificial Sequence; identical to SEQ ID NO: 2427
  Synthetic polypeptide

SEQ ID NO: 4048 - DNA, 1439 bp, Artificial Sequence; identical to SEQ ID NO: 2428
  Synthetic polypeptide

SEQ ID NO: 4049 - DNA, 1352 bp, Artificial Sequence; identical to SEQ ID NO: 2429
  Synthetic polypeptide

SEQ ID NO: 4050 - DNA, 602 bp, Artificial Sequence; identical to SEQ ID NO: 2430
  Synthetic polypeptide

SEQ ID NO: 4051 - DNA, 645 bp, Artificial Sequence
  Synthetic polypeptide
atggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacaccatacaatttatatttatcaagtacaccaagaaagagaaccaagaggaaaaaaagacaatagaaacgggacatccctccactccacccccacaaacacacaggtaacttggttatcagacacagacttaaaaatggttgtgatcagtgcattcaagaaaatagaggacaagatggtaaattttattaaaaagaaactaagtggaaatcttagaactgaaaaatagaataatagagattaagaactcagtagatgggtttagtagcagactggactcagtagaatagag

SEQ ID NO: 4052 - DNA, 1262 bp, Artificial Sequence
  Synthetic polypeptide
atgttcaggtccaaacgctcggggctggtgcggcgactttggcgaagtcgtgtggtccccgaccgggaggaaggcggcagcggcggcggcggtggcggcgacgaggatgggagcttgggcagccgagctgagccggccccgcgggcaagagagggcggaggctgcggccgctccgaagtccgcccggtagccccgcggcggccccgggacgcagtgggacagcgaggcgcccagggcgcggggaggcgccggcgcgcagggggccccccgaggcccatgtcggagccaggggccggcgctgggagctccctgctggacgtggcggagccgggaggcccgggctggctgcccgagagtgactgcgagacggtgacctgctgtctcttttcggagcgggacgccgccggcgcgccccgggacgccagcgaccccctggccggggcggccctggagccggcgggcggcgggcggagtcgcgaagcgcgctcgcggctgctgctgctggagcaggaactcaaaaccgtcacgtactcgctgctgaagcggctcaaggagcgctcgctggacacgctgctggaggcggtggagtcccgcggcggcgtgccgggcggctgcgtgctggtgccgcgcgccgacctccgcctgggcggccagcccgcgccgccgcagctgctgctcggccgcctctttcgctggcccgacctgcagcacgccgtggagctgaagcccctgtgcggctgccacagcttcgccgccgccgccgacggccctaccgtgtgctgcaacccctaccacttcagccggctctgcgggcccgccaaagagaggaagcaacccaaatgtccattagctgataaatggataaatgaaatatggtacgtccgaagaatggaatatcattcacccatgaaaaagaacgaagtccagcaccaaaacgtgctacaacatggatgaacttcgatgactttgtgccacatgaaagaagaagccagccacaaaaggccatatattgtatgaaatgaaatgtccagaatgggcaaacccatagagacacaaagtaagttagtggttgcccagggttttggggttggggtctagaaagtgactgccaatggggatggtgtttctttttgcgataaaaaaaatgtcttgtgtttagatggtggttgatggttgcacaacactgtgaatatactcaaaaaccactgaatggtatatttttaaaaaggatgaatcttagggtatgtgaattatatctcaat

SEQ ID NO: 4053 - DNA, 1081 bp, Artificial Sequence; identical to SEQ ID NO: 986
  Synthetic polypeptide

SEQ ID NO: 4054 - DNA, 1054 bp, Artificial Sequence; identical to SEQ ID NO: 987
  Synthetic polypeptide

SEQ ID NO: 4055 - DNA, 372 bp, Artificial Sequence; identical to SEQ ID NO: 1188
  Synthetic polypeptide

SEQ ID NO: 4056 - DNA, 681 bp, Artificial Sequence; identical to SEQ ID NO: 1642
  Synthetic polypeptide

SEQ ID NO: 4057 - DNA, 534 bp, Artificial Sequence; identical to SEQ ID NO: 1643
  Synthetic polypeptide

SEQ ID NO: 4058 - DNA, 270 bp, Artificial Sequence; identical to SEQ ID NO: 1644
  Synthetic polypeptide

SEQ ID NO: 4059 - DNA, 596 bp, Artificial Sequence; identical to SEQ ID NO: 1645
  Synthetic polypeptide

SEQ ID NO: 4060 - DNA, 840 bp, Artificial Sequence; identical to SEQ ID NO: 1937
  Synthetic polypeptide

SEQ ID NO: 4061 - DNA, 840 bp, Artificial Sequence; identical to SEQ ID NO: 1937
  Synthetic polypeptide

SEQ ID NO: 4062 - DNA, 1587 bp, Artificial Sequence; identical to SEQ ID NO: 3984
  Synthetic polypeptide

SEQ ID NO: 4063 - DNA, 840 bp, Artificial Sequence; identical to SEQ ID NO: 2402
  Synthetic polypeptide

SEQ ID NO: 4064 - DNA, 671 bp, Artificial Sequence
  Synthetic polypeptide
atgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctcgtgtagagactctatctctacacaaaacaaatattaaaaaaaaaaaaaaaa

SEQ ID NO: 4065 - DNA, 823 bp, Artificial Sequence; identical to SEQ ID NO: 1941
  Synthetic polypeptide

SEQ ID NO: 4066 - DNA, 715 bp, Artificial Sequence; identical to SEQ ID NO: 1942
  Synthetic polypeptide

SEQ ID NO: 4067 - DNA, 299 bp, Artificial Sequence; identical to SEQ ID NO: 1943
  Synthetic polypeptide

SEQ ID NO: 4068 - DNA, 148 bp, Artificial Sequence; identical to SEQ ID NO: 1944
  Synthetic polypeptide

SEQ ID NO: 4069 - DNA, 1705 bp, Artificial Sequence; identical to SEQ ID NO: 1989
  Synthetic polypeptide

SEQ ID NO: 4070 - DNA, 343 bp, Artificial Sequence
  Synthetic polypeptide
atgcgcatgcacacccggctctcccttccaggccctccccaccacgtgggcgcggcctaccctcccgcagggggtaatagaagcgagaacgccggatcctggggcggggctggagcttcgtcagttgaaccgctcgcgaggagggttgctagtggagaagcctggatctctgccctgaactccagactcatatcatggccgactcttctctctttggaagttcatctgacattcagacataaacttgtcccaaaccaatcttgcgatttcttcctttcaacctccaaacccagttgatgggacattcatcctgccaggtactaagatcaagaagcttggagtg

SEQ ID NO: 4071 - DNA, 466 bp, Artificial Sequence; identical to SEQ ID NO: 2137
  Synthetic polypeptide

SEQ ID NO: 4072 - DNA, 534 bp, Artificial Sequence
  Synthetic polypeptide
ccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacgtgtttctcc

SEQ ID NO: 4073 - DNA, 543 bp, Artificial Sequence
  Synthetic polypeptide
atggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacgtgtttctcc

SEQ ID NO: 4074 - DNA, 822 bp, Artificial Sequence; identical to SEQ ID NO: 119
  Synthetic polypeptide

SEQ ID NO: 4075 - DNA, 2721 bp, Artificial Sequence; identical to SEQ ID NO: 962
  Synthetic polypeptide

SEQ ID NO: 4076 - DNA, 2549 bp, Artificial Sequence; identical to SEQ ID NO: 963
  Synthetic polypeptide

SEQ ID NO: 4077 - DNA, 320 bp, Artificial Sequence
  Synthetic polypeptide
atggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctggtggccgaggcgcggcggcccgcgcccttcgaagtggtcttcgtgtcagccgacggcagctcccaggagatgctggacttcatgcgcgagctgcatggcgcctggctggcgctgcccttccacgacccctaccggcaccggagccaactaataca

SEQ ID NO: 4078 - DNA, 2520 bp, Artificial Sequence
  Synthetic polypeptide
atggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccagcccacccctgcacagcccctcctccttcccgcttttccccttctccctcct

SEQ ID NO: 4079 - DNA, 1128 bp, Artificial Sequence
  Synthetic polypeptide
atgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccagcccacccctgcacagcccctcctccttcccgcttttccccttctccctcct

SEQ ID NO: 4080 - DNA, 70 bp, Artificial Sequence
  Synthetic polypeptide
ggacgtgattggcctccagcccacccctgcacagcccctcctccttcccgcttttccccttctccctcct

SEQ ID NO: 4081 - DNA, 1273 bp, Artificial Sequence; identical to SEQ ID NO: 2173
  Synthetic polypeptide

SEQ ID NO: 4082 - DNA, 369 bp, Artificial Sequence; identical to SEQ ID NO: 1672
  Synthetic polypeptide

SEQ ID NO: 4083 - DNA, 410 bp, Artificial Sequence; identical to SEQ ID NO: 1673
  Synthetic polypeptide

SEQ ID NO: 4084 - DNA, 582 bp, Artificial Sequence
  Synthetic polypeptide
atggggcctgaaaggcatctgtcaggcgcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccagccaggtgtggtggcacatgcctgcagttccagctactcaggaagcttactggagttccagctactcaaggttggaggatcccttgcgcccaggagttcaagtctcccatgagctatgatcacaccaactgcactccagcctgaacaacaaaacaacactgtctctaaagataaaaa

SEQ ID NO: 4085 - DNA, 2362 bp, Artificial Sequence; identical to SEQ ID NO: 1664
  Synthetic polypeptide

SEQ ID NO: 4086 - DNA, 2113 bp, Artificial Sequence; identical to SEQ ID NO: 1665
  Synthetic polypeptide

SEQ ID NO: 4087 - DNA, 1399 bp, Artificial Sequence; identical to SEQ ID NO: 1666
  Synthetic polypeptide

SEQ ID NO: 4088 - DNA, 2080 bp, Artificial Sequence; identical to SEQ ID NO: 1667
  Synthetic polypeptide

SEQ ID NO: 4089 - DNA, 575 bp, Artificial Sequence; identical to SEQ ID NO: 2296
  Synthetic polypeptide

SEQ ID NO: 4090 - DNA, 487 bp, Artificial Sequence; identical to SEQ ID NO: 918
  Synthetic polypeptide

SEQ ID NO: 4091 - DNA, 281 bp, Artificial Sequence; identical to SEQ ID NO: 2021
  Synthetic polypeptide

SEQ ID NO: 4092 - DNA, 248 bp, Artificial Sequence; identical to SEQ ID NO: 2022
  Synthetic polypeptide

SEQ ID NO: 4093 - DNA, 609 bp, Artificial Sequence; identical to SEQ ID NO: 249
  Synthetic polypeptide

SEQ ID NO: 4094 - DNA, 738 bp, Artificial Sequence; identical to SEQ ID NO: 250
  Synthetic polypeptide

SEQ ID NO: 4095 - DNA, 537 bp, Artificial Sequence; identical to SEQ ID NO: 251
  Synthetic polypeptide

SEQ ID NO: 4096 - DNA, 684 bp, Artificial Sequence; identical to SEQ ID NO: 253
  Synthetic polypeptide

SEQ ID NO: 4097 - DNA, 285 bp, Artificial Sequence; identical to SEQ ID NO: 255
  Synthetic polypeptide

SEQ ID NO: 4098 - DNA, 552 bp, Artificial Sequence; identical to SEQ ID NO: 254
  Synthetic polypeptide

SEQ ID NO: 4099 - DNA, 3203 bp, Artificial Sequence
  Synthetic polypeptide
atgccggggccccggcgccccgctggctcccgcctgcgcctgctcctgctcctgctgctgccgccgctgctgctgctgctccggggcagccacgcgggcaacctgacggtagccgtggtactgccgctggccaatacctcgtacccctggtcgtgggcgcgcgtgggacccgccgtggagctggccctggcccaggtgaaggcgcgccccgacttgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgagttatctacatctgcagctcccctgatgccttcagaaccctcatgctcctggccctggaagctggcttgtgtggggaggactacgttttcttccacctggatatctttgggcaaagcctgcaaggtggacagggccctgctccccgcaggccctgggagagaggggatgggcaggatgtcagtgcccgccaggcctttcaggctgccaaaatcattacatataaagacccagataatcccgagtacttggaattcctgaagcagttaaaacacctggcctatgagcagttcaacttcaccatggaggatggcctggtgaacaccatcccagcatccttccacgacgggctcctgctctatatccaggcagtgacggagactctggcacatgggggaactgttactgatggggagaacatcactcagcggatgtggaaccgaagctttcaaggtgtgacaggatacctgaaaattgatagcagtggcgatcgggaaacagacttctccctctgggatatggatcccgagaatggtgccttcagggttgtactgaactacaatgggacttcccaagagctggtggctgtgtcggggcgcaaactgaactggcccctggggtaccctcctcctgacatccccaaatgtggctttgacaacgaagacccagcatgcaaccaagatcacctttccaccctggaggtgctggctttggtgggcagcctctccttgctcggcattctgattgtctccttcttcatatacaggaagatgcagctggagaaggaactggcctcggagctgtggcgggtgcgctgggaggacgttgagcccagtagccttgagaggcacctgcggagtgcaggcagccggctgaccctgagcgggagaggctccaattacggctccctgctaaccacagagggccagttccaagtctttgccaagacagcatattataagggcaacctcgtggctgtgaaacgtgtgaaccgtaaacgcattgagctgacacgaaaagtcctgtttgaactgaagcatatgcgggatgtgcagaatgaacacctgaccaggtttgtgggagcctgcaccgacccccccaatatctgcatcctcacagagtactgtccccgtgggagcctgcaggacattctggagaatgagagcatcaccctggactggatgttccggtactcactcaccaatgacatcgtcaagggcatgctgtttctacacaatggggctatctgttcccatgggaacctcaagtcatccaactgcgtggtagatgggcgctttgtgctcaagatcaccgactatgggctggagagcttcagggacctggacccagagcaaggacacaccgtttatgccaaaaagctgtggacggcccctgagctcctgcgaatggcttcaccccctgtgcggggctcccaggctggtgacgtatacagctttgggatcatccttcaggagattgccctgaggagtggggtcttccacgtggaaggtttggacctgagccccaaagagatcatcgagcgggtgactcggggtgagcagccccccttccggccctccctggccctgcagagtcacctggaggagttggggctgctcatgcagcggtgctgggctgaggacccacaggagaggccaccattccagcagatccgcctgacgttgcgcaaatttaacagggagaacagcagcaacatcctggacaacctgctgtcccgcatggagcagtacgcgaacaatctggaggaactggtggaggagcggacccaggcatacctggaggagaagcgcaaggctgaggccctgctctaccagatcctgcctcactcagtggctgagcagctgaagcgtggggagacggtgcaggccgaagcctttgacagtgttaccatctacttcagtgacattgtgggtttcacagcgctgtcggcggagagcacacccatgcaggtggtgaccctgctcaatgacctgtacacttgctttgatgctgtcatagacaactttgatgtgtacaaggtggagacaattggcgatgcctacatggtggtgtcagggctccctgtgcggaacgggcggctacacgcctgcgaggtagcccgcatggccctggcactgctggatgctgtgcgctccttccgaatccgccaccggccccaggagcagctgcgcttgcgcattggcatccacacaggacctgtgtgtgctggagtggtgggactgaagatgccccgttactgtctctttggggatacagtcaacacagcctcaagaatggagtctaatggggaagccaggtgtgatggcaggctcctgtaatcccagctacttgggaggctgaggcagaagaattgcttgaacccgggaggcagaggttgcgatgagccaagattacaccacgcaccccagcttgggcaataagagttaaactctgtctcaaaaaaaaaaaaaaaaaaaaaaaaaaa

SEQ ID NO: 4100 - DNA, 1412 bp, Artificial Sequence
  Synthetic polypeptide
atggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggttgttgtcatctgagttgagcactggtcacattgaaggtgctgggtaagtggtagctct

SEQ ID NO: 4101 - DNA, 324 bp, Artificial Sequence
  Synthetic polypeptide
ctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggttgttgtcatctgagttgagcactggtcacattgaaggtgctgggtaagtggtagctct

SEQ ID NO: 4102 - DNA, 764 bp, Artificial Sequence
  Synthetic polypeptide
atgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggttgttgtcatctgagttgagcactggtcacattgaaggtgctgggtaagtggtagctct

SEQ ID NO: 4103 - DNA, 1289 bp, Artificial Sequence
  Synthetic polypeptide
atgggggcgggggaacagaacaggcaaagtgcccactgtgtgcagggcatatgcgggtacctggagggagatgaagaaggggaagagggggaggtgcgaagcactcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggttgttgtcatctgagttgagcactggtcacattgaaggtgctgggtaagtggtagctct

SEQ ID NO: 4104 - DNA, 285 bp, Artificial Sequence
  Synthetic polypeptide
aatccccatggtatctttggagaacctacctctgtagagaggcagtagactctgaagtcacctgtcgtaagaacgtgagctttcctcttcacatgctgcttatattccctattaagtttgtttcttttctagaaaaaattgaaagaactgtccagattgaggcttcaactgttgaaattgaagagcgaggggtcaagctacgcctgacagtggtagatacccctggctatggtgacgctatcaactgcagagattgtcacgttcctgaaaagaattggcagccct

SEQ ID NO: 4105 - DNA, 370 bp, Artificial Sequence
  Synthetic polypeptide
atgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgtcacgttcctgaaaagaattggcagccct

SEQ ID NO: 4106 - DNA, 250 bp, Artificial Sequence
  Synthetic polypeptide
atggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgtcacgttcctgaaaagaattggcagccct

SEQ ID NO: 4107 - DNA, 400 bp, Artificial Sequence
  Synthetic polypeptide
atgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagctttgaacacaaggaaaacacttttatgggaaaaaattgaaagaactgtccagattgaggcttcaactgttgaaattgaagagcgaggggtcaagctacgcctgacagtggtagatacccctggctatggtgacgctatcaactgcagagattgtcacgttcctgaaaagaattggcagccct

SEQ ID NO: 4108 - DNA, 403 bp, Artificial Sequence
  Synthetic polypeptide
atggagttcaactctaacgtcaagtcttggtccttttcattgcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgtcacgttcctgaaaagaattggcagccct

SEQ ID NO: 4109 - DNA, 317 bp, Artificial Sequence; identical to SEQ ID NO: 995
  Synthetic polypeptide

SEQ ID NO: 4110 - DNA, 578 bp, Artificial Sequence; identical to SEQ ID NO: 1946
  Synthetic polypeptide

SEQ ID NO: 4111 - DNA, 488 bp, Artificial Sequence; identical to SEQ ID NO: 1947
  Synthetic polypeptide

SEQ ID NO: 4112 - DNA, 479 bp, Artificial Sequence; identical to SEQ ID NO: 1948
  Synthetic polypeptide

SEQ ID NO: 4113 - DNA, 470 bp, Artificial Sequence; identical to SEQ ID NO: 1949
  Synthetic polypeptide

SEQ ID NO: 4114 - DNA, 39 bp, Artificial Sequence; identical to SEQ ID NO: 2401
  Synthetic polypeptide

SEQ ID NO: 4115 - DNA, 605 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccaggggg

SEQ ID NO: 4116 - DNA, 542 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttgtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccaggggg

SEQ ID NO: 4117 - DNA, 1834 bp, Artificial Sequence; identical to SEQ ID NO: 133
  Synthetic polypeptide

SEQ ID NO: 4118 - DNA, 1765 bp, Artificial Sequence; identical to SEQ ID NO: 135
  Synthetic polypeptide

SEQ ID NO: 4119 - DNA, 227 bp, Artificial Sequence
  Synthetic polypeptide
atggagctgcctgctgtgaacctgaaggtgattctcctaggtcactggctgctgacaacctggtcactttgggccagacagctctgcctctccgggtcttgatttccgtctgtacaataggcataaggattgcacaccctgcaggagctgggagggagacgtggaagtgctcatcagagctccccagggcctgccccacagtgaggcctcagcactgcagcttgatt

SEQ ID NO: 4120 - DNA, 263 bp, Artificial Sequence
  Synthetic polypeptide
atggagctgcctgctgtgaacctgaagtgcgccagctccagtgtcccaagaaatcaccctcacgtgattctcctaggtcactggctgctgacaacctggtcactttgggccagacagctctgcctctccgggtcttgatttccgtctgtacaataggcataaggattgcacaccctgcaggagctgggagggagacgtggaagtgctcatcagagctccccagggcctgccccacagtgaggcctcagcactgcagcttgatt

SEQ ID NO: 4121 - DNA, 303 bp, Artificial Sequence; identical to SEQ ID NO: 148
  Synthetic polypeptide

SEQ ID NO: 4122 - DNA, 301 bp, Artificial Sequence; identical to SEQ ID NO: 147
  Synthetic polypeptide

SEQ ID NO: 4123 - DNA, 5801 bp, Artificial Sequence; identical to SEQ ID NO: 2012
  Synthetic polypeptide

SEQ ID NO: 4124 - DNA, 708 bp, Artificial Sequence; identical to SEQ ID NO: 2013
  Synthetic polypeptide

SEQ ID NO: 4125 - DNA, 169 bp, Artificial Sequence
  Synthetic polypeptide
atggcaaccgttccaggtgtggtggtgcaggcctgtaatcccagctactcagaaggctgaggcaggagaatcgcttgaacctgggaggcagaagttgcagtgagccaagatcgcgccactgcattccagcctgggcgacaaagcgagactctgtctccaaaaaaaaaaa

SEQ ID NO: 4126 - DNA, 610 bp, Artificial Sequence; identical to SEQ ID NO: 163
  Synthetic polypeptide

SEQ ID NO: 4127 - DNA, 216 bp, Artificial Sequence
  Synthetic polypeptide
atggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccctagcaaaccaa

SEQ ID NO: 4128 - DNA, 150 bp, Artificial Sequence
  Synthetic polypeptide
gtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccctagcaaaccaa

SEQ ID NO: 4129 - DNA, 79 bp, Artificial Sequence
  Synthetic polypeptide
cagtctagccggcctgggtgcttaccagctgtatcaggatccaaggaacgtttggggtttcctagccctagcaaaccaa

SEQ ID NO: 4130 - DNA, 438 bp, Artificial Sequence
  Synthetic polypeptide
atggggcctgaaaggcatctgtcaggcgcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccaggaatgtataatgtacaaaatagaagactgcct

SEQ ID NO: 4131 - DNA, 1441 bp, Artificial Sequence
  Synthetic polypeptide
atggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgtaacactcaccacgaaggtctgcagcttcactcctgaagccagcgagaccacgaacccaccgggaggaacgaacaactccagatgcgccgccttaagagctgtaacactcaccgcgaaggtccgtggcctcactcctgagcccccaagaccacgaacccaccagaaggaagaaactccaaacacatccgaacatcagaaggaacaaactctggacacgctgactttaagaactgtaacactcaccgcgaaggtctgcggcttcattcttgaagtcagtgagaccaagaacccaccaattccggacaca

SEQ ID NO: 4132 - DNA, 1450 bp, Artificial Sequence
  Synthetic polypeptide
atggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaaggtgaaagagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgtaacactcaccacgaaggtctgcagcttcactcctgaagccagcgagaccacgaacccaccgggaggaacgaacaactccagatgcgccgccttaagagctgtaacactcaccgcgaaggtccgtggcctcactcctgagcccccaagaccacgaacccaccagaaggaagaaactccaaacacatccgaacatcagaaggaacaaactctggacacgctgactttaagaactgtaacactcaccgcgaaggtctgcggcttcattcttgaagtcagtgagaccaagaacccaccaattccggacaca

SEQ ID NO: 4133 - DNA, 887 bp, Artificial Sequence
  Synthetic polypeptide
gggaagcccagtggaggacaatgagaaggatctggtgaaactggctaaacgcctcaagaaggagaaagtaaatgttgacattatcaattttggggaagaggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgtaacactcaccacgaaggtctgcagcttcactcctgaagccagcgagaccacgaacccaccgggaggaacgaacaactccagatgcgccgccttaagagctgtaacactcaccgcgaaggtccgtggcctcactcctgagcccccaagaccacgaacccaccagaaggaagaaactccaaacacatccgaacatcagaaggaacaaactctggacacgctgactttaagaactgtaacactcaccgcgaaggtctgcggcttcattcttgaagtcagtgagaccaagaacccaccaattccggacaca

SEQ ID NO: 4134 - DNA, 561 bp, Artificial Sequence
  Synthetic polypeptide
acattgatgccagctcagctatggacacatctgagccagccaagagctcaattaacagagttctcagcaggcccctctatttggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgtaacactcaccacgaaggtctgcagcttcactcctgaagccagcgagaccacgaacccaccgggaggaacgaacaactccagatgcgccgccttaagagctgtaacactcaccgcgaaggtccgtggcctcactcctgagcccccaagaccacgaacccaccagaaggaagaaactccaaacacatccgaacatcagaaggaacaaactctggacacgctgactttaagaactgtaacactcaccgcgaaggtctgcggcttcattcttgaagtcagtgagaccaagaacccaccaattccggacaca

SEQ ID NO: 4135 - DNA, 503 bp, Artificial Sequence
  Synthetic polypeptide
atgtgtggaactggggggactgattccaagacaaggcgcccaccccacagagcaagttttctgaaacgtttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgaggggagggga

SEQ ID NO: 4136 - DNA, 413 bp, Artificial Sequence
  Synthetic polypeptide
atggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgaggggagggga

SEQ ID NO: 4137 - DNA, 415 bp, Artificial Sequence; identical to SEQ ID NO: 2355
  Synthetic polypeptide

SEQ ID NO: 4138 - DNA, 259 bp, Artificial Sequence; identical to SEQ ID NO: 2356
  Synthetic polypeptide

SEQ ID NO: 4139 - DNA, 559 bp, Artificial Sequence; identical to SEQ ID NO: 1701
  Synthetic polypeptide

SEQ ID NO: 4140 - DNA, 2153 bp, Artificial Sequence; identical to SEQ ID NO: 217
  Synthetic polypeptide

SEQ ID NO: 4141 - DNA, 1664 bp, Artificial Sequence; identical to SEQ ID NO: 222
  Synthetic polypeptide

SEQ ID NO: 4142 - DNA, 1766 bp, Artificial Sequence; identical to SEQ ID NO: 221
  Synthetic polypeptide

SEQ ID NO: 4143 - DNA, 281 bp, Artificial Sequence; identical to SEQ ID NO: 1368
  Synthetic polypeptide

SEQ ID NO: 4144 - DNA, 674 bp, Artificial Sequence
  Synthetic polypeptide
atggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaa

SEQ ID NO: 4145 - DNA, 620 bp, Artificial Sequence
  Synthetic polypeptide
atgcctgccctccggacaaggcggggttggtggccagggcgaccgcggggcgggccagcgccgggggtcgtggccgggacacgtggtacggaaccggcgccgcgcttgctgctggtaacagggccttgcctagtgggccttccttcccagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaa

SEQ ID NO: 4146 - DNA, 586 bp, Artificial Sequence; identical to SEQ ID NO: 401
  Synthetic polypeptide

SEQ ID NO: 4147 - DNA, 829 bp, Artificial Sequence; identical to SEQ ID NO: 402
  Synthetic polypeptide

SEQ ID NO: 4148 - DNA, 1060 bp, Artificial Sequence; identical to SEQ ID NO: 403
  Synthetic polypeptide

SEQ ID NO: 4149 - DNA, 730 bp, Artificial Sequence; identical to SEQ ID NO: 406
  Synthetic polypeptide

SEQ ID NO: 4150 - DNA, 496 bp, Artificial Sequence; identical to SEQ ID NO: 408
  Synthetic polypeptide

SEQ ID NO: 4151 - DNA, 3881 bp, Artificial Sequence; identical to SEQ ID NO: 1162
  Synthetic polypeptide

SEQ ID NO: 4152 - DNA, 3722 bp, Artificial Sequence; identical to SEQ ID NO: 1163
  Synthetic polypeptide

SEQ ID NO: 4153 - DNA, 535 bp, Artificial Sequence; identical to SEQ ID NO: 2819
  Synthetic polypeptide

SEQ ID NO: 4154 - DNA, 1041 bp, Artificial Sequence; identical to SEQ ID NO: 2160
  Synthetic polypeptide

SEQ ID NO: 4155 - DNA, 987 bp, Artificial Sequence; identical to SEQ ID NO: 2161
  Synthetic polypeptide

SEQ ID NO: 4156 - DNA, 1089 bp, Artificial Sequence; identical to SEQ ID NO: 2162
  Synthetic polypeptide

SEQ ID NO: 4157 - DNA, 678 bp, Artificial Sequence; identical to SEQ ID NO: 2163
  Synthetic polypeptide

SEQ ID NO: 4158 - DNA, 1868 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggagggaaggagagggagggtgggtgggtgggaggggg

SEQ ID NO: 4159 - DNA, 535 bp, Artificial Sequence; identical to SEQ ID NO: 2819
  Synthetic polypeptide

SEQ ID NO: 4160 - DNA, 441 bp, Artificial Sequence
  Synthetic polypeptide
atgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagac

SEQ ID NO: 4161 - DNA, 419 bp, Artificial Sequence
  Synthetic polypeptide
tgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagac

SEQ ID NO: 4162 - DNA, 272 bp, Artificial Sequence
  Synthetic polypeptide
ggagcctgcgcctgtgggattcccacgtatgcggagtgagcctgctcagccaccgctgggcactcacggcggcgcactgctttgaaacataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagac

SEQ ID NO: 4163 - DNA, 1806 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccccgcatcctagtcccacccacccccatcctcagttcctccccc

SEQ ID NO: 4164 - DNA, 1854 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggagggtgggtgggtgggaggggg

SEQ ID NO: 4165 - DNA, 258 bp, Artificial Sequence; identical to SEQ ID NO: 265
  Synthetic polypeptide

SEQ ID NO: 4166 - DNA, 243 bp, Artificial Sequence; identical to SEQ ID NO: 267
  Synthetic polypeptide

SEQ ID NO: 4167 - DNA, 324 bp, Artificial Sequence; identical to SEQ ID NO: 268
  Synthetic polypeptide

SEQ ID NO: 4168 - DNA, 2161 bp, Artificial Sequence; identical to SEQ ID NO: 288
  Synthetic polypeptide

SEQ ID NO: 4169 - DNA, 2140 bp, Artificial Sequence; identical to SEQ ID NO: 289
  Synthetic polypeptide

SEQ ID NO: 4170 - DNA, 529 bp, Artificial Sequence; identical to SEQ ID NO: 287
  Synthetic polypeptide

SEQ ID NO: 4171 - DNA, 1075 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgggg

SEQ ID NO: 4172 - DNA, 951 bp, Artificial Sequence; identical to SEQ ID NO: 1109
  Synthetic polypeptide

SEQ ID NO: 4173 - DNA, 1036 bp, Artificial Sequence; identical to SEQ ID NO: 1110
  Synthetic polypeptide

SEQ ID NO: 4174 - DNA, 871 bp, Artificial Sequence; identical to SEQ ID NO: 1111
  Synthetic polypeptide

SEQ ID NO: 4175 - DNA, 569 bp, Artificial Sequence; identical to SEQ ID NO: 1768
  Synthetic polypeptide

SEQ ID NO: 4176 - DNA, 497 bp, Artificial Sequence; identical to SEQ ID NO: 1769
  Synthetic polypeptide

SEQ ID NO: 4177 - DNA, 415 bp, Artificial Sequence
  Synthetic polypeptide
atgtgtggaactggggggactgattccaagacaaggcgcccaccccacagagcaagttttctgaaacgtttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggagggga

SEQ ID NO: 4178 - DNA, 325 bp, Artificial Sequence
  Synthetic polypeptide
atggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggagggga

SEQ ID NO: 4179 - DNA, 951 bp, Artificial Sequence; identical to SEQ ID NO: 1127
  Synthetic polypeptide

SEQ ID NO: 4180 - DNA, 1036 bp, Artificial Sequence; identical to SEQ ID NO: 1128
  Synthetic polypeptide

SEQ ID NO: 4181 - DNA, 871 bp, Artificial Sequence; identical to SEQ ID NO: 1129
  Synthetic polypeptide

SEQ ID NO: 4182 - DNA, 839 bp, Artificial Sequence
  Synthetic polypeptide
atggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaat

SEQ ID NO: 4183 - DNA, 924 bp, Artificial Sequence
  Synthetic polypeptide
atggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaat

SEQ ID NO: 4184 - DNA, 759 bp, Artificial Sequence
  Synthetic polypeptide
atggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaat

SEQ ID NO: 4185 - DNA, 775 bp, Artificial Sequence; identical to SEQ ID NO: 215
  Synthetic polypeptide

SEQ ID NO: 4186 - DNA, 839 bp, Artificial Sequence
  Synthetic polypeptide
atggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaat

SEQ ID NO: 4187 - DNA, 924 bp, Artificial Sequence
  Synthetic polypeptide
atggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaat

SEQ ID NO: 4188 - DNA, 759 bp, Artificial Sequence
  Synthetic polypeptide
atggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaat

SEQ ID NO: 4189 - DNA, 47 bp, Artificial Sequence; identical to SEQ ID NO: 2014
  Synthetic polypeptide

SEQ ID NO: 4190 - DNA, 577 bp, Artificial Sequence; identical to SEQ ID NO: 1112
  Synthetic polypeptide

SEQ ID NO: 4191 - DNA, 252 bp, Artificial Sequence; identical to SEQ ID NO: 1113
  Synthetic polypeptide

SEQ ID NO: 4192 - DNA, 310 bp, Artificial Sequence
  Synthetic polypeptide
atggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagcagccctagcaaaccaa

SEQ ID NO: 4193 - DNA, 208 bp, Artificial Sequence
  Synthetic polypeptide
atggagaagcccctcttcccattagtgcctttgcattggtttggctttggctacacagcactggttgtttctggtgggatcgttggctatgtaaaaacagccgctacatctgttacttttgttggtgttatgggaatgagatcctactactatggaaaattcatgcctgtaggtttaattgcaggtgccagcagccctagcaaaccaa

SEQ ID NO: 4194 - DNA, 131 bp, Artificial Sequence
  Synthetic polypeptide
atggagaagcccctcttcccattccgctacatctgttacttttgttggtgttatgggaatgagatcctactactatggaaaattcatgcctgtaggtttaattgcaggtgccagcagccctagcaaaccaa

SEQ ID NO: 4195 - DNA, 173 bp, Artificial Sequence
  Synthetic polypeptide
cagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagcagccctagcaaaccaa

SEQ ID NO: 4196 - DNA, 2962 bp, Artificial Sequence; identical to SEQ ID NO: 2377
  Synthetic polypeptide

SEQ ID NO: 4197 - DNA, 2899 bp, Artificial Sequence; identical to SEQ ID NO: 2378
  Synthetic polypeptide

SEQ ID NO: 4198 - DNA, 2902 bp, Artificial Sequence; identical to SEQ ID NO: 2379
  Synthetic polypeptide

SEQ ID NO: 4199 - DNA, 2839 bp, Artificial Sequence; identical to SEQ ID NO: 2380
  Synthetic polypeptide

SEQ ID NO: 4200 - DNA, 1195 bp, Artificial Sequence
  Synthetic polypeptide
atggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggtacttggagggctcagggcagtggcttctttccagtatggaaggatttcaacattttaatagttggttaggctaaactggtgcatactggcattggccct

SEQ ID NO: 4201 - DNA, 1183 bp, Artificial Sequence
  Synthetic polypeptide
atggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggtacttggagggctcagggcagtggcttctttccagtatggaaggatttcaacattttaatagttggttaggctaaactggtgcatactggcattggccct

SEQ ID NO: 4202 - DNA, 163 bp, Artificial Sequence
  Synthetic polypeptide
atggcccgggccgctgccctcctgccgtcgagatcgccgccgacgccgctgctgtggccgctgctgctgctgctgctcctggaaaccggactattcacaataccaaagacatggactcaatccaaatgcccatcatggatagactggataaagaaaatgtaca

SEQ ID NO: 4203 - DNA, 568 bp, Artificial Sequence; identical to SEQ ID NO: 1967
  Synthetic polypeptide

SEQ ID NO: 4204 - DNA, 379 bp, Artificial Sequence; identical to SEQ ID NO: 1968
  Synthetic polypeptide

SEQ ID NO: 4205 - DNA, 1024 bp, Artificial Sequence
  Synthetic polypeptide
atggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaa

SEQ ID NO: 4206 - DNA, 970 bp, Artificial Sequence
  Synthetic polypeptide
atggagggagctgctttgctgagagtctctgtcctctgcatctgggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaa

SEQ ID NO: 4207 - DNA, 1072 bp, Artificial Sequence
  Synthetic polypeptide
atgagattcaaaagccacactgtggaattgaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaa

SEQ ID NO: 4208 - DNA, 661 bp, Artificial Sequence
  Synthetic polypeptide
atgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaa

SEQ ID NO: 4209 - DNA, 2160 bp, Artificial Sequence
  Synthetic polypeptide
atgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatggccttgatctaggggatctccttagccttcctcccgggacatccatgtccagcaatagtgtctctaactcattaccatcctacctttttggcacggaaagtagccactctccttaccctagtcctcggcactcatccaccaggtcccactcggcccgctccaagaagagagcgctgtccttgtccccgctgtccgatggcatcgggatagatttcaataccatcatccgcacgtcgcccacgtccttggtggcctacatcaacgggtcgagggcttcgccggccaacctgtccccgcagccggaggtctacgggcatttcctgggcgtgcgcggcagctgcattccccagccgcgcccggtgcccggcagccagaagggcgtgctggtggcccctggaggcctggcgctgccggcctacggcgaggacggggccctggagcacgagcgcatgcaacagctggagcacggcggcctgcagccaggcctggtcaaccacatggtggtgcagcatggcctgccgggccccgacagccagtcggccggcctgttcaagaccgaacgcctggaggagttcccgggcagcaccgtagacctaccccccgcgcctccgctccctcctctgccgccgcccccaggccccccacccccttaccatgcccatgcgcaccttcaccacccggagctcgggccccacgcccagcagctggccttgccccaggccaccctggacgacgacggggagatggacggcatcgggggcaagcattgctgccgctggatcgactgcagcgccctgtacgaccagcaggaggagctcgtgcggcacatcgagaaggtccacatcgaccagcgcaaaggggaggacttcacttgcttctgggccggttgccctcgaagatacaagcccttcaacgcccgctataaactgctgatccacatgagagtccactctggggagaagcccaacaagtgtacgtttgaaggttgcgagaaggccttttcaaggcttgaaaatctcaagatccacttgcggagccacacaggcgagaagccgtatttgtgccagcatccgggttgtcagaaggccttcagtaactccagtgaccgcgccaaacaccagcggacgcatctggacaccaaaccttatgcttgtcaaattccaggatgtaccaaacgctacacagacccaagttccctaagaaagcatgtgaaggcacattcttccaaagagcaacaagcaaggaaaaagttgcggtccagcacagagctccatccagacctgctcacagattgcctcaccgtgcagtccctgcagccggccacttcccctagagatgctgctgctgaagggaccgtgggacgctcccctggacccgggcctgacctctattcagctcccattttctccagcaattattcaagccgaagtggaacagctgctggggccgtaccacccccacatcctgtcagtcacccttctccaggacataatgtacaggggagccctcacaacccctcctcccagttacctccactcacagctgtggacgcaggagctgagaggtttgcaccttctgctccatctcctcaccacatcagcccccggagagttccagctccttcttcaatactgcaaagaacacagcctccctatacccagcagccatcaggttcacacctgaagtcctatcagccagaaacaaactcttcttttcaaccaaatggtatccatgtccatggtccacatcctctccgtccttcaaggcgcaggtggaatgacacctcctctctgaagcccttcctgatcccccagctgatgtcatctctccaggctctaaactctgattttatatcgcctgtctttctctggtagtatttatgcttcctctac

SEQ ID NO: 4210 - DNA, 2625 bp, Artificial Sequence
  Synthetic polypeptide
atgaatggaagatcatgcagcatgagtctccaccggacatcgggaaccccacaggggcctaggatggtcagtggtcatcacattcctgccatccgagcccactccgggactcctggcccctcgccctgtggcagcacatcgagtcccactatggcaagccttgctaacaacctccatctcaagatgccctcaggaggagggatggctcctcagaacaacgtggctgagagccgcatccatctgcctgccttaagccccaggagacaaatgctcaccaatgggaagccgcgattccaggtcacccaggctggaggcatgtcagggtcacatactttaaagccaaagcagcaggagtttggaagcccttttcctccaaatcctgggaaaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatggccttgatctaggggatctccttagccttcctcccgggacatccatgtccagcaatagtgtctctaactcattaccatcctacctttttggcacggaaagtagccactctccttaccctagtcctcggcactcatccaccaggtcccactcggcccgctccaagaagagagcgctgtccttgtccccgctgtccgatggcatcgggatagatttcaataccatcatccgcacgtcgcccacgtccttggtggcctacatcaacgggtcgagggcttcgccggccaacctgtccccgcagccggaggtctacgggcatttcctgggcgtgcgcggcagctgcattccccagccgcgcccggtgcccggcagccagaagggcgtgctggtggcccctggaggcctggcgctgccggcctacggcgaggacggggccctggagcacgagcgcatgcaacagctggagcacggcggcctgcagccaggcctggtcaaccacatggtggtgcagcatggcctgccgggccccgacagccagtcggccggcctgttcaagaccgaacgcctggaggagttcccgggcagcaccgtagacctaccccccgcgcctccgctccctcctctgccgccgcccccaggccccccacccccttaccatgcccatgcgcaccttcaccacccggagctcgggccccacgcccagcagctggccttgccccaggccaccctggacgacgacggggagatggacggcatcgggggcaagcattgctgccgctggatcgactgcagcgccctgtacgaccagcaggaggagctcgtgcggcacatcgagaaggtccacatcgaccagcgcaaaggggaggacttcacttgcttctgggccggttgccctcgaagatacaagcccttcaacgcccgctataaactgctgatccacatgagagtccactctggggagaagcccaacaagtgtacgtttgaaggttgcgagaaggccttttcaaggcttgaaaatctcaagatccacttgcggagccacacaggcgagaagccgtatttgtgccagcatccgggttgtcagaaggccttcagtaactccagtgaccgcgccaaacaccagcggacgcatctggacaccaaaccttatgcttgtcaaattccaggatgtaccaaacgctacacagacccaagttccctaagaaagcatgtgaaggcacattcttccaaagagcaacaagcaaggaaaaagttgcggtccagcacagagctccatccagacctgctcacagattgcctcaccgtgcagtccctgcagccggccacttcccctagagatgctgctgctgaagggaccgtgggacgctcccctggacccgggcctgacctctattcagctcccattttctccagcaattattcaagccgaagtggaacagctgctggggccgtaccacccccacatcctgtcagtcacccttctccaggacataatgtacaggggagccctcacaacccctcctcccagttacctccactcacagctgtggacgcaggagctgagaggtttgcaccttctgctccatctcctcaccacatcagcccccggagagttccagctccttcttcaatactgcaaagaacacagcctccctatacccagcagccatcaggttcacacctgaagtcctatcagccagaaacaaactcttcttttcaaccaaatggtatccatgtccatggtccacatcctctccgtccttcaaggcgcaggtggaatgacacctcctctctgaagcccttcctgatcccccagctgatgtcatctctccaggctctaaactctgattttatatcgcctgtctttctctggtagtatttatgcttcctctac

SEQ ID NO: 4211 - DNA, 436 bp, Artificial Sequence; identical to SEQ ID NO: 2387
  Synthetic polypeptide

SEQ ID NO: 4212 - DNA, 454 bp, Artificial Sequence; identical to SEQ ID NO: 2388
  Synthetic polypeptide

SEQ ID NO: 4213 - DNA, 349 bp, Artificial Sequence; identical to SEQ ID NO: 2389
  Synthetic polypeptide

SEQ ID NO: 4214 - DNA, 577 bp, Artificial Sequence; identical to SEQ ID NO: 2390
  Synthetic polypeptide

SEQ ID NO: 4215 - DNA, 439 bp, Artificial Sequence; identical to SEQ ID NO: 2391
  Synthetic polypeptide

SEQ ID NO: 4216 - DNA, 616 bp, Artificial Sequence; identical to SEQ ID NO: 2392
  Synthetic polypeptide

SEQ ID NO: 4217 - DNA, 459 bp, Artificial Sequence; identical to SEQ ID NO: 237
  Synthetic polypeptide

SEQ ID NO: 4218 - DNA, 158 bp, Artificial Sequence
  Synthetic polypeptide
atgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcag

SEQ ID NO: 4219 - DNA, 65 bp, Artificial Sequence
  Synthetic polypeptide
atggccacagaagttgctgctgacgctctgggtgaagaatggaagggttatgtggtccgaatcag

SEQ ID NO: 4220 - DNA, 335 bp, Artificial Sequence; identical to SEQ ID NO: 2120
  Synthetic polypeptide

SEQ ID NO: 4221 - DNA, 615 bp, Artificial Sequence; identical to SEQ ID NO: 1055
  Synthetic polypeptide

SEQ ID NO: 4222 - DNA, 861 bp, Artificial Sequence; identical to SEQ ID NO: 1056
  Synthetic polypeptide

SEQ ID NO: 4223 - DNA, 62 bp, Artificial Sequence; identical to SEQ ID NO: 1057
  Synthetic polypeptide

SEQ ID NO: 4224 - DNA, 123 bp, Artificial Sequence; identical to SEQ ID NO: 1058
  Synthetic polypeptide

SEQ ID NO: 4225 - DNA, 585 bp, Artificial Sequence; identical to SEQ ID NO: 2385
  Synthetic polypeptide

SEQ ID NO: 4226 - DNA, 579 bp, Artificial Sequence; identical to SEQ ID NO: 2386
  Synthetic polypeptide

SEQ ID NO: 4227 - DNA, 1487 bp, Artificial Sequence; identical to SEQ ID NO: 2023
  Synthetic polypeptide

SEQ ID NO: 4228 - DNA, 1538 bp, Artificial Sequence; identical to SEQ ID NO: 2024
  Synthetic polypeptide

SEQ ID NO: 4229 - DNA, 1427 bp, Artificial Sequence; identical to SEQ ID NO: 2025
  Synthetic polypeptide

SEQ ID NO: 4230 - DNA, 237 bp, Artificial Sequence
  Synthetic polypeptide
atgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggctaaggtgtttcattgtaacctgaatggaccaag

SEQ ID NO: 4231 - DNA, 660 bp, Artificial Sequence
  Synthetic polypeptide
atgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggctaaggtgtttcattgtaacctgaatggaccaag

SEQ ID NO: 4232 - DNA, 506 bp, Artificial Sequence; identical to SEQ ID NO: 1096
  Synthetic polypeptide

SEQ ID NO: 4233 - DNA, 435 bp, Artificial Sequence
  Synthetic polypeptide
atgtgtggaactggggggactgattccaagacaaggcgcccaccccacagagcaagttttctgaaacgtttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggagggaagaggaggagaggggagggga

SEQ ID NO: 4234 - DNA, 345 bp, Artificial Sequence
  Synthetic polypeptide
atggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggagggaagaggaggagaggggagggga

SEQ ID NO: 4235 - DNA, 1859 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggggg

SEQ ID NO: 4236 - DNA, 728 bp, Artificial Sequence
  Synthetic polypeptide
atgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaactgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagac

SEQ ID NO: 4237 - DNA, 734 bp, Artificial Sequence
  Synthetic polypeptide
atgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagac

SEQ ID NO: 4238 - DNA, 706 bp, Artificial Sequence
  Synthetic polypeptide
tgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaactgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagac

SEQ ID NO: 4239 - DNA, 559 bp, Artificial Sequence
  Synthetic polypeptide
ggagcctgcgcctgtgggattcccacgtatgcggagtgagcctgctcagccaccgctgggcactcacggcggcgcactgctttgaaactgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagac

SEQ ID NO: 4240 - DNA, 557 bp, Artificial Sequence
  Synthetic polypeptide
atggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggaggatcgcttgagaccaagagtttgagcctgcggtgagctgtgaatgcaccacggcactcaagcctgggcaatgtagcaagatcctgtctctacaagaaa

SEQ ID NO: 4241 - DNA, 503 bp, Artificial Sequence
  Synthetic polypeptide
atgcctgccctccggacaaggcggggttggtggccagggcgaccgcggggcgggccagcgccgggggtcgtggccgggacacgtggtacggaaccggcgccgcgcttgctgctggtaacagggccttgcctagtgggccttccttcccagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggaggatcgcttgagaccaagagtttgagcctgcggtgagctgtgaatgcaccacggcactcaagcctgggcaatgtagcaagatcctgtctctacaagaaa

SEQ ID NO: 4242 - DNA, 3093 bp, Artificial Sequence; identical to SEQ ID NO: 341
  Synthetic polypeptide

SEQ ID NO: 4243 - DNA, 2979 bp, Artificial Sequence; identical to SEQ ID NO: 342
  Synthetic polypeptide

SEQ ID NO: 4244 - DNA, 3078 bp, Artificial Sequence; identical to SEQ ID NO: 343
  Synthetic polypeptide

SEQ ID NO: 4245 - DNA, 3072 bp, Artificial Sequence; identical to SEQ ID NO: 346
  Synthetic polypeptide

SEQ ID NO: 4246 - DNA, 1935 bp, Artificial Sequence; identical to SEQ ID NO: 347
  Synthetic polypeptide

SEQ ID NO: 4247 - DNA, 1096 bp, Artificial Sequence; identical to SEQ ID NO: 348
  Synthetic polypeptide

SEQ ID NO: 4248 - DNA, 902 bp, Artificial Sequence; identical to SEQ ID NO: 349
  Synthetic polypeptide

SEQ ID NO: 4249 - DNA, 874 bp, Artificial Sequence; identical to SEQ ID NO: 350
  Synthetic polypeptide

SEQ ID NO: 4250 - DNA, 1296 bp, Artificial Sequence; identical to SEQ ID NO: 1428
  Synthetic polypeptide

SEQ ID NO: 4251 - DNA, 1299 bp, Artificial Sequence; identical to SEQ ID NO: 1429
  Synthetic polypeptide

SEQ ID NO: 4252 - DNA, 543 bp, Artificial Sequence; identical to SEQ ID NO: 1430
  Synthetic polypeptide

SEQ ID NO: 4253 - DNA, 1194 bp, Artificial Sequence; identical to SEQ ID NO: 1431
  Synthetic polypeptide

SEQ ID NO: 4254 - DNA, 706 bp, Artificial Sequence; identical to SEQ ID NO: 1432
  Synthetic polypeptide

SEQ ID NO: 4255 - DNA, 578 bp, Artificial Sequence; identical to SEQ ID NO: 1433
  Synthetic polypeptide

SEQ ID NO: 4256 - DNA, 564 bp, Artificial Sequence; identical to SEQ ID NO: 1434
  Synthetic polypeptide

SEQ ID NO: 4257 - DNA, 513 bp, Artificial Sequence; identical to SEQ ID NO: 1435
  Synthetic polypeptide

SEQ ID NO: 4258 - DNA, 299 bp, Artificial Sequence; identical to SEQ ID NO: 1033
  Synthetic polypeptide

SEQ ID NO: 4259 - DNA, 191 bp, Artificial Sequence; identical to SEQ ID NO: 1034
  Synthetic polypeptide

SEQ ID NO: 4260 - DNA, 516 bp, Artificial Sequence
  Synthetic polypeptide
atggaactcttaacattcagggatgtggccatagaattctctccagaagagtggaaatgcctggaccctgcccagcagaatttgtatagagatgtgatgttggagaactacaggaacctgatctccctgggtgttgctatctctaacccagacctggtcatctatctggagcaaagaaaggagccctacaaagtgaagatacatgagacagtagccaaacacccaggccactggactatgctccaccttcagtctgagccagcatacaaccctcttgatacctctcccaagaacaggctgacttcagggtgaaacattctctaatcttgaatctgattttgctgttctccattctgccctctgccatcttctttctaatcttgtttgctcctccatatgaaaaatagcctttatctgtctcattttggaggtgcttgcagatcttatgcttggtgctttttccattgcaatactccttaaaataaagtcacttcttacctacatcagaatttattt

SEQ ID NO: 4261 - DNA, 241 bp, Artificial Sequence
  Synthetic polypeptide
atgcctctcctgcgtgggcgctgtcctgcccgccgccactaccgccgcttggccctgctcggcctgcagcccgctccccgcttcgcccactcggggcccccgcgccagcggcccctgtctgccgcggtatggtggtgtgcacctggaattccagctacttgggagactgaagcagaaggatcacttgaggccaggagtttgagaccagcctggacaacatagtgagattcctgtctcaaaa

SEQ ID NO: 4262 - DNA, 2095 bp, Artificial Sequence; identical to SEQ ID NO: 2095
  Synthetic polypeptide

SEQ ID NO: 4263 - DNA, 55 bp, Artificial Sequence; identical to SEQ ID NO: 291
  Synthetic polypeptide

SEQ ID NO: 4264 - DNA, 25 bp, Artificial Sequence
  Synthetic polypeptide
atgagcgtcctttcgtttttttaaa

SEQ ID NO: 4265 - DNA, 918 bp, Artificial Sequence
  Synthetic polypeptide
atggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggaggctgaggcaggagaatcgcttgaacccgggaggcagaggttgcggtgagccgagatcgtgccgttgcactccagcctgggaacaacagcgaaaccctgtctcaaaaaaaaaattaaaaaaataaaataa

SEQ ID NO: 4266 - DNA, 684 bp, Artificial Sequence
  Synthetic polypeptide
atgatgggagcctcaacacttcaggagccggccctaagtcctggcaggtgcccccgccagcccctgaggtccaaattcggacaccaagggtcaactgtccagagaaagtgctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggaggctgaggcaggagaatcgcttgaacccgggaggcagaggttgcggtgagccgagatcgtgccgttgcactccagcctgggaacaacagcgaaaccctgtctcaaaaaaaaaattaaaaaaataaaataa

SEQ ID NO: 4267 - DNA, 918 bp, Artificial Sequence
  Synthetic polypeptide
atggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaacatcagtggggcctcacctgcccgccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggaggctgaggcaggagaatcgcttgaacccgggaggcagaggttgcggtgagccgagatcgtgccgttgcactccagcctgggaacaacagcgaaaccctgtctcaaaaaaaaaattaaaaaaataaaataa

SEQ ID NO: 4268 - DNA, 693 bp, Artificial Sequence
  Synthetic polypeptide
atggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggaggctgaggcaggagaatcgcttgaacccgggaggcagaggttgcggtgagccgagatcgtgccgttgcactccagcctgggaacaacagcgaaaccctgtctcaaaaaaaaaattaaaaaaataaaataa

SEQ ID NO: 4269 - DNA, 228 bp, Artificial Sequence
  Synthetic polypeptide
cccctgcagaaaatgttccagtgcccatatttcttctttgacgttgtttacatccacaatggcactgaggagaaggaggaggagatgagttggaaggaggctgaggcaggagaatcgcttgaacccgggaggcagaggttgcggtgagccgagatcgtgccgttgcactccagcctgggaacaacagcgaaaccctgtctcaaaaaaaaaattaaaaaaataaaataa

SEQ ID NO: 4270 - DNA, 1863 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggagagggagggtgggtgggtgggaggggg

SEQ ID NO: 4271 - DNA, 118 bp, Artificial Sequence
  Synthetic polypeptide
atgccgcgcccccgcctgctggccgcgctgtgcggcgcgctgctctgcgcccccagcctcctcgtcgccctggacccagctcaaatattccctcctctggggaacttctaattcccca

SEQ ID NO: 4272 - DNA, 865 bp, Artificial Sequence; identical to SEQ ID NO: 366
  Synthetic polypeptide

SEQ ID NO: 4273 - DNA, 391 bp, Artificial Sequence
  Synthetic polypeptide
atgggactagctggcgtgtgcgccctgagacgctcagcgggctatatactcgtcggtggggccggcggtcagtctgcggcagcggcagcaagacggtacagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccagattacttcctccacccctccctatctca

SEQ ID NO: 4274 - DNA, 399 bp, Artificial Sequence
  Synthetic polypeptide
atgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcggcgcgggacgcaggccgggcgcgggagggcgcgg

SEQ ID NO: 4275 - DNA, 429 bp, Artificial Sequence
  Synthetic polypeptide
cccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtatgtgtgctccgatgcttggggggctgtgggggctgccggagtcggggtatgccctcacccacccctcctgtctctgtgcaggtgctatgctcgccttcaccctcgtgctgtcaactgccgcaagaagaagtgtggtcacaccaacaacctgcggcgcgggacgcaggccgggcgcgggagggcgcgg

SEQ ID NO: 4276 - DNA, 278 bp, Artificial Sequence
  Synthetic polypeptide
gtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaaaagtgtggtcacaccaacaacctgcggcgcgggacgcaggccgggcgcgggagggcgcgg

SEQ ID NO: 4277 - DNA, 1980 bp, Artificial Sequence
  Synthetic polypeptide
atgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgagatcctgaacttcacagatgagctcacaccacccagattgataaactggcctatctcatcctgtggccccctcccaggaagtgactcagcacgagaggacagtatcaactccctatgatttcatctctcacctgaccaatcagaactcttgactcactggcccccctacccaccaaattatctttaaaaactccagtcctcaaattctcagagagactgatttgaataataacaaaactctggtgtactgcacagctggctctgcatgaattactctttattgcaatttctctgttttgataagtaagatctttcttgataaataagctctgtctaggcagtgggcaaggtgaacccgttaggtggttaca

SEQ ID NO: 4278 - DNA, 1584 bp, Artificial Sequence
  Synthetic polypeptide
atggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgagatcctgaacttcacagatgagctcacaccacccagattgataaactggcctatctcatcctgtggccccctcccaggaagtgactcagcacgagaggacagtatcaactccctatgatttcatctctcacctgaccaatcagaactcttgactcactggcccccctacccaccaaattatctttaaaaactccagtcctcaaattctcagagagactgatttgaataataacaaaactctggtgtactgcacagctggctctgcatgaattactctttattgcaatttctctgttttgataagtaagatctttcttgataaataagctctgtctaggcagtgggcaaggtgaacccgttaggtggttaca

SEQ ID NO: 4279 - DNA, 1974 bp, Artificial Sequence
  Synthetic polypeptide
atgtttctgaccaagaattgcaagcaagaacaggaaagagtggagtcggccaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgagatcctgaacttcacagatgagctcacaccacccagattgataaactggcctatctcatcctgtggccccctcccaggaagtgactcagcacgagaggacagtatcaactccctatgatttcatctctcacctgaccaatcagaactcttgactcactggcccccctacccaccaaattatctttaaaaactccagtcctcaaattctcagagagactgatttgaataataacaaaactctggtgtactgcacagctggctctgcatgaattactctttattgcaatttctctgttttgataagtaagatctttcttgataaataagctctgtctaggcagtgggcaaggtgaacccgttaggtggttaca

SEQ ID NO: 4280 - DNA, 177 bp, Artificial Sequence
  Synthetic polypeptide
atggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagagaaaaatatttgttgaatgagtgaa

SEQ ID NO: 4281 - DNA, 567 bp, Artificial Sequence
  Synthetic polypeptide
atggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaattacctccatgttgcaggtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgccccagcccccagctccaggagacagatttgagccaggctcctgtctttctctgcagccttgcaataaacttttctttctacaaaaacccagtgctttggtgtttgga

SEQ ID NO: 4282 - DNA, 495 bp, Artificial Sequence
  Synthetic polypeptide
atggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaattacctccatgttgcaggtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgccccagcccccagctccaggagacagatttgagccaggctcctgtctttctctgcagccttgcaataaacttttctttctacaaaaacccagtgctttggtgtttgga

SEQ ID NO: 4283 - DNA, 840 bp, Artificial Sequence; identical to SEQ ID NO: 1937
  Synthetic polypeptide

SEQ ID NO: 4284 - DNA, 757 bp, Artificial Sequence
  Synthetic polypeptide
atgctgaaaagcaacggggagagacgcagtcgtaacgcacttccggcggtctacgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgcgcctggcgcatgagtgcctgtcacagagttgtgacagtgccaagcactctccaacgttggtgcccacagccaccaagcccgacgcagtgcaggcaggcagatggcttgagcccaggaattcaagaccagtccgagcaacatagcaaaagcccttatctgcaaaaaattcaaaaattagccaggtgtggtggtgcgtgcccaggttcccaggtactcggaggctgagaggtgggaggatgccttgagcttgagaggttgaagctgcagtgagctgtgatcgcaccactgcactccagcttggttcatggagaccctgtttttttaaaaaaagaa

SEQ ID NO: 4285 - DNA, 624 bp, Artificial Sequence
  Synthetic polypeptide
atggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgccaccaagcccgacgcagtgcaggcaggcagatggcttgagcccaggaattcaagaccagtccgagcaacatagcaaaagcccttatctgcaaaaaattcaaaaattagccaggtgtggtggtgcgtgcccaggttcccaggtactcggaggctgagaggtgggaggatgccttgagcttgagaggttgaagctgcagtgagctgtgatcgcaccactgcactccagcttggttcatggagaccctgtttttttaaaaaaagaa

SEQ ID NO: 4286 - DNA, 694 bp, Artificial Sequence
  Synthetic polypeptide
atggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgcgcctggcgcatgagtgcctgtcacagagttgtgacagtgccaagcactctccaacgttggtgcccacagccaccaagcccgacgcagtgcaggcaggcagatggcttgagcccaggaattcaagaccagtccgagcaacatagcaaaagcccttatctgcaaaaaattcaaaaattagccaggtgtggtggtgcgtgcccaggttcccaggtactcggaggctgagaggtgggaggatgccttgagcttgagaggttgaagctgcagtgagctgtgatcgcaccactgcactccagcttggttcatggagaccctgtttttttaaaaaaagaa

SEQ ID NO: 4287 - DNA, 717 bp, Artificial Sequence
  Synthetic polypeptide
atggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctggtaagaagccttctggacacgggcgcctggcgcatgagtgcctgtcacagagttgtgacagtgccaagcactctccaacgttggtgcccacagccaccaagcccgacgcagtgcaggcaggcagatggcttgagcccaggaattcaagaccagtccgagcaacatagcaaaagcccttatctgcaaaaaattcaaaaattagccaggtgtggtggtgcgtgcccaggttcccaggtactcggaggctgagaggtgggaggatgccttgagcttgagaggttgaagctgcagtgagctgtgatcgcaccactgcactccagcttggttcatggagaccctgtttttttaaaaaaagaa

SEQ ID NO: 4288 - DNA, 396 bp, Artificial Sequence
  Synthetic polypeptide
atgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggctacaaaaatctgactcattcttcaagacctagttccagagccacctcctccaggaaaacttccaagtcctccaggc

SEQ ID NO: 4289 - DNA, 95 bp, Artificial Sequence
  Synthetic polypeptide
atgtcgcgatccaaccggcagaaggagtacaaatgcggggacctggtgttcgccaagatgaagggctacccacactggccggcccggagttccct

SEQ ID NO: 4290 - DNA, 584 bp, Artificial Sequence
  Synthetic polypeptide
atggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctgggttgttggtgtggagtggaagatgaggcggcaccttctaagcagagtatttatatacaaagagagactcagatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagcccctacccgccaaattttgaaaactctgatcccagaatgctcagggagactgatttgaataataaaactcctgtctcccgaacagcaggacggctctgcgtgaattactatttctccatcgcaattccccagtcttcataaatcggctctgtctaggcagctggcaacgtgaacccactggacggttaca

SEQ ID NO: 4291 - DNA, 167 bp, Artificial Sequence
  Synthetic polypeptide
atggagttgcagaagggaaaaggggcggcagcagcagcagctgcttcgggagcagcgggaggtggaggaggaggagcgggagcaggagccccaggaggggggaggctgctactttcaaccagtttggatgccaaggatgagttagaggagatctctgcacacagaag

SEQ ID NO: 4292 - DNA, 508 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggaggggg

SEQ ID NO: 4293 - DNA, 445 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttgtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggaggggg

SEQ ID NO: 4294 - DNA, 729 bp, Artificial Sequence; identical to SEQ ID NO: 202
  Synthetic polypeptide

SEQ ID NO: 4295 - DNA, 1142 bp, Artificial Sequence; identical to SEQ ID NO: 2159
  Synthetic polypeptide

SEQ ID NO: 4296 - DNA, 1327 bp, Artificial Sequence
  Synthetic polypeptide
atgtccatccacttcagctccccggtattcacctcgcgctcagccgccttctcgggccgcggcgcccaggtgcgcctgagctccgctcgccccggcggccttggcagcagcagcctctacggcctcggcgcctcacggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccaccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcgcagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcggggcaagcaggatatggcacggcagctgcgtgagtaccaggaactcatgagcgtgaagctggccctggacatcgagatcgccacctaccgcaagctgctggagggcgaggagagccggtaaaggaagcttttcaagatctatcaactgaggacaatcaaacccttcacaatctagaatgcagagatcaggtcatctggagacgatatctgagaaagactgccattgagccccattggag

SEQ ID NO: 4297 - DNA, 572 bp, Artificial Sequence; identical to SEQ ID NO: 159
  Synthetic polypeptide

SEQ ID NO: 4298 - DNA, 792 bp, Artificial Sequence
  Synthetic polypeptide
atgcagcccccgcccccgggcccgctgggcgactgcctgcgggactgggaggatctacagcaggacttccagaacatccaggagacccatcggctctaccgcctgaagctggaggagctgaccaaactttagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggcaaggtca

SEQ ID NO: 4299 - DNA, 77 bp, Artificial Sequence; identical to SEQ ID NO: 1778
  Synthetic polypeptide

SEQ ID NO: 4300 - DNA, 1213 bp, Artificial Sequence; identical to SEQ ID NO: 1093
  Synthetic polypeptide

SEQ ID NO: 4301 - DNA, 616 bp, Artificial Sequence; identical to SEQ ID NO: 1094
  Synthetic polypeptide

SEQ ID NO: 4302 - DNA, 868 bp, Artificial Sequence; identical to SEQ ID NO: 1095
  Synthetic polypeptide

SEQ ID NO: 4303 - DNA, 598 bp, Artificial Sequence
  Synthetic polypeptide
atggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggccatgcaaggacacagtgagaaggtgaccatatgcaagccaggaagaagaccttcaccaggaatccaaccagctggcacgttgaccttggacttcttggactccagaactatgagaaataaatgtctgctgtttaagccacctaggtgacagcattctgtgacagcagcctgcactaagaca

SEQ ID NO: 4304 - DNA, 526 bp, Artificial Sequence
  Synthetic polypeptide
atggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttccttcagcacctcacccactggacagagcccatacacctaccagatgcacggccatgcaaggacacagtgagaaggtgaccatatgcaagccaggaagaagaccttcaccaggaatccaaccagctggcacgttgaccttggacttcttggactccagaactatgagaaataaatgtctgctgtttaagccacctaggtgacagcattctgtgacagcagcctgcactaagaca

SEQ ID NO: 4305 - DNA, 457 bp, Artificial Sequence
  Synthetic polypeptide
cagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggccatgcaaggacacagtgagaaggtgaccatatgcaagccaggaagaagaccttcaccaggaatccaaccagctggcacgttgaccttggacttcttggactccagaactatgagaaataaatgtctgctgtttaagccacctaggtgacagcattctgtgacagcagcctgcactaagaca

SEQ ID NO: 4306 - DNA, 798 bp, Artificial Sequence; identical to SEQ ID NO: 3839
  Synthetic polypeptide

SEQ ID NO: 4307 - DNA, 349 bp, Artificial Sequence
  Synthetic polypeptide
atggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggtgtttctcc

SEQ ID NO: 4308 - DNA, 340 bp, Artificial Sequence
  Synthetic polypeptide
ccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggtgtttctcc

SEQ ID NO: 4309 - DNA, 707 bp, Artificial Sequence
  Synthetic polypeptide
atggcccgttcttacggcggccgggtgctggctgcaatgaccctgctgggcatcgcggcggccgtgctggcggcgctgggcgcgcagctgctgtttcagctgcaggcgggccgcgccgagctgcgggggctgcgcgccgaggggctgggccaggagctgggcgccggccccgggctgccagaggacgcggccgggacgctgctgccgctggccgccgcgctggccgcgctggtgctcgtgctggggttcacctgcttgctgctcgccgcgctctgtggccacctgggcgccgagctggcgcgggggcctggccccaggaggtctgactggtttctctacgactgccgcctcctcagacatgtggcccttggccttttctgctgtgggatctccgtctatttagcaggccggacgcggtggctcacgcctgtaatcccagcactttgggagaccgaggcgggcagatcacgaggtcaggagatcgagaccatcctggctaacaaggtgaaaccccatctctactaaaaatacaaaaattagccgggtgtggtggcgggcggctgtagtcccagctactcgggaggctgaggcaggagaatggcgtgaacccgggaggcagagcttgcagtgagccgagattgcgccactgcactccagcctgggtgacagagcgagattccatctcaaaaaaaaaaaaaaaaaaaaaa

SEQ ID NO: 4310 - DNA, 662 bp, Artificial Sequence
  Synthetic polypeptide
atgccaaagaaatggcttttcctgccctttgaggatgatctgaggagggacctcgggcgccagttctcagtggagcgcctgccggcggtcgtggtgctcaagccggacggggacgtgctcactcgcgacggcgccgacgagatccagcgcctgggcaccgcctgcttcgccaactggcaggaggcggccgaggtgctggaccgcaacttccagctgccagaggacctggaggaccaggagccacggagcctcaccgagtgcctgcgccgccacaagtctgactggtttctctacgactgccgcctcctcagacatgtggcccttggccttttctgctgtgggatctccgtctatttagcaggccggacgcggtggctcacgcctgtaatcccagcactttgggagaccgaggcgggcagatcacgaggtcaggagatcgagaccatcctggctaacaaggtgaaaccccatctctactaaaaatacaaaaattagccgggtgtggtggcgggcggctgtagtcccagctactcgggaggctgaggcaggagaatggcgtgaacccgggaggcagagcttgcagtgagccgagattgcgccactgcactccagcctgggtgacagagcgagattccatctcaaaaaaaaaaaaaaaaaaaaaa

SEQ ID NO: 4311 - DNA, 798 bp, Artificial Sequence
  Synthetic polypeptide
atggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaagaaagaagaaattaagaaaatgataagtgaaattgataaggaagggacaggaaaaatgaactttggtgactttttaactgtgatgacccagaaaatgtctgagaaagatactaaagaagaaatcctgaaagctttcaagctctttgatgatgatgaaactgggaagatttcgttcaaaaatctgaaacgcgtggccaaggagttgggtgagaacctgactgatgaggagctgcaggaaatgattgatgaagctgatcgagatggagatggagagggacatggatggagctggaagccattatcctcagcaaactaacccaggaacaggaaaccaaacaccacttgttctcactcgtgagtgggagctgaacagagagaacacgtagttacagggaaggggacaatatacataggggcctgtcggtggcagtgggggtgggggtgtggggggagggagaacatcaggataaatagctaatgcatgtggggcttaacacctaggtgatgggttgataggtgcagcaaaccaccgtggcacacgtttacctatgcaaccagcacgtcctgcacatgtatcccggaacttaacttaaaaaaaaaaaaa

SEQ ID NO: 4312 - DNA, 614 bp, Artificial Sequence
  Synthetic polypeptide
atgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtagaggttggagtgagccaagatcatgctactgcactctccagcctgggctacagagtgagactctcaaaaaaaaaaaataataataataagagaaa

SEQ ID NO: 4313 - DNA, 704 bp, Artificial Sequence
  Synthetic polypeptide
atgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgatgaggacgcaagcaagcgcactcttcagatgtcacttctcacgggaggcctctgtgattgcagaaggaaaggccccagcagaactcaccatctgccgcctgaggctccaccacctcgaagacatccttgcaagatccacagactggcccagaccaggaggtttctgtcttcttcttgtgtcttcttcactctcctggactggttcgtgaaccctttctcctatctctgtttcctctggatgttaagtgctactttctttgttgtggaacgttaacctgtaacatgtatatactgattaagtacactattacgttgtcgtgtgcaatattggctgacatgtgcagtggcttgagcccgtgtgaccgcagctctcactactgagggaaaggagcactaagcagcatgcctccttgggaacgccgtgtggctcgtggctttagggattgaaatagcctcaataaaattctgacattgtgaaagacacaggcatgcttggatgtgattatctctaactttgcactgctcatgaca

SEQ ID NO: 4314 - DNA, 364 bp, Artificial Sequence; identical to SEQ ID NO: 2649
  Synthetic polypeptide

SEQ ID NO: 4315 - DNA, 1312 bp, Artificial Sequence
  Synthetic polypeptide
atggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcccacgtctggccaggcactgccttctcctctctgggcctttgtttccttgttggtcagaggagtgattgaaccagctcatctccaaggatcctctccactccatgtttgcaatgcttttat

SEQ ID NO: 4316 - DNA, 1069 bp, Artificial Sequence
  Synthetic polypeptide
atggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccgcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcccacgtctggccaggcactgccttctcctctctgggcctttgtttccttgttggtcagaggagtgattgaaccagctcatctccaaggatcctctccactccatgtttgcaatgcttttat

SEQ ID NO: 4317 - DNA, 1132 bp, Artificial Sequence
  Synthetic polypeptide
atggccgagggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcccacgtctggccaggcactgccttctcctctctgggcctttgtttccttgttggtcagaggagtgattgaaccagctcatctccaaggatcctctccactccatgtttgcaatgcttttat

SEQ ID NO: 4318 - DNA, 1394 bp, Artificial Sequence; identical to SEQ ID NO: 1118
  Synthetic polypeptide

SEQ ID NO: 4319 - DNA, 1625 bp, Artificial Sequence; identical to SEQ ID NO: 1119
  Synthetic polypeptide

SEQ ID NO: 4320 - DNA, 1505 bp, Artificial Sequence; identical to SEQ ID NO: 1120
  Synthetic polypeptide

SEQ ID NO: 4321 - DNA, 1562 bp, Artificial Sequence; identical to SEQ ID NO: 1121
  Synthetic polypeptide

SEQ ID NO: 4322 - DNA, 1601 bp, Artificial Sequence; identical to SEQ ID NO: 1122
  Synthetic polypeptide

SEQ ID NO: 4323 - DNA, 1631 bp, Artificial Sequence; identical to SEQ ID NO: 1123
  Synthetic polypeptide

SEQ ID NO: 4324 - DNA, 976 bp, Artificial Sequence; identical to SEQ ID NO: 2334
  Synthetic polypeptide

SEQ ID NO: 4325 - DNA, 1009 bp, Artificial Sequence; identical to SEQ ID NO: 2335
  Synthetic polypeptide

SEQ ID NO: 4326 - DNA, 1132 bp, Artificial Sequence; identical to SEQ ID NO: 2336
  Synthetic polypeptide

SEQ ID NO: 4327 - DNA, 563 bp, Artificial Sequence; identical to SEQ ID NO: 2337
  Synthetic polypeptide

SEQ ID NO: 4328 - DNA, 396 bp, Artificial Sequence
  Synthetic polypeptide
atggaagatgcactctttctgcggatcagtgtttgagatattttgcagaccctgcacttgatggatcagctggcaccaccgactaataaactggcttatctgatgttgtggcctccactcaggaactgactgaaggcaggaagacagcttcaactccctgtgatttcacccctgaccaatcaccacacctggctcactggctaccccccaactcccacccaccaagttatccttaaaaactctgctctccaaatgctcagggagactgatttgagtaataaaactccagtctcccacacagctggctctgcgtgaattactttattgcaactcccctgccttgatgaattggctctgtctaggcagcaggcaaggtgaaccccttgggtggttaca

SEQ ID NO: 4329 - DNA, 1979 bp, Artificial Sequence
  Synthetic polypeptide
atggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgattcactctctaccagctctttgacctagaaaggttgcttttaaggacaacatcagcaaaccactttccttccagctattatttggttcagcaagtggagggc

SEQ ID NO: 4330 - DNA, 1931 bp, Artificial Sequence
  Synthetic polypeptide
atggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagttcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgattcactctctaccagctctttgacctagaaaggttgcttttaaggacaacatcagcaaaccactttccttccagctattatttggttcagcaagtggagggc

SEQ ID NO: 4331 - DNA, 52 bp, Artificial Sequence
  Synthetic polypeptide
atgacgcgctgggtgcccaccaagcgcgaggagaagtacggcgtggcacctg

SEQ ID NO: 4332 - DNA, 997 bp, Artificial Sequence
  Synthetic polypeptide
atggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggctataagcaccataagggcagagaccatgaacatttttttttatttccccaaccacgcgcagtacacagggcagaattgctcaataaatatttgttgaatgaatgaat

SEQ ID NO: 4333 - DNA, 610 bp, Artificial Sequence
  Synthetic polypeptide
cagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggctataagcaccataagggcagagaccatgaacatttttttttatttccccaaccacgcgcagtacacagggcagaattgctcaataaatatttgttgaatgaatgaat

SEQ ID NO: 4334 - DNA, 1875 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccagggggtgggtgggtgggaggggg

SEQ ID NO: 4335 - DNA, 1622 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccggggg

SEQ ID NO: 4336 - DNA, 1119 bp, Artificial Sequence
  Synthetic polypeptide
atgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtgggtagatcacctgaggtcaggagttcgaggtcaacctgagcaacaaggtaaaatcccatctttactaataatacaaaaattagccaggcgtggtggtgtgcacctgtagtcccagctactcgggaggctgaggcaggggaatcgcttgaacctgggaggcggaggttgcagtgagctgagatcgcaccactgcactccagcctgggtgacagagcgagactctgtctcaaaataaataaataaataaataaa

SEQ ID NO: 4337 - DNA, 316 bp, Artificial Sequence; identical to SEQ ID NO: 2265
  Synthetic polypeptide

SEQ ID NO: 4338 - DNA, 383 bp, Artificial Sequence
  Synthetic polypeptide
atggcagcggctgcgccgaggcgcccgactcagatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagcccctacccgccaaattttgaaaactctgatcccagaatgctcagggagactgatttgaataataaaactcctgtctcccgaacagcaggacggctctgcgtgaattactatttctccatcgcaattccccagtcttcataaatcggctctgtctaggcagctggcaacgtgaacccactggacggttaca

SEQ ID NO: 4339 - DNA, 415 bp, Artificial Sequence
  Synthetic polypeptide
atggaactccacatcctggagcaccggctgcaagttgccagcgtcgccaaggagagtatcccgctgttcacctacggcctgatcaaacttgccttcctgtcctccaagaccagatcccttgctctgtaggaaaccaacccccaaggcctgaagacacccaagcagccccatggagaggcccatatggagaggaactgaggcatcccacccccaaccggcagctcggggctttgaaaacagatccttccgccccaggcaagccttccaatggattgcagccccagccaatgccttgaactgccaagttcagccacacctaaattcctaacccataggaactgtgagagataataaaagtttgttgttgtttcaagccactaagatctggggtaatttgttatgtagcaacagataa

SEQ ID NO: 4340 - DNA, 831 bp, Artificial Sequence
  Synthetic polypeptide
caggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctgggggtggggacctcactggatgcacaatgttatgtctgtgctttcctgagcagaggatccctaaatttcattatattttaaaagacatctgtgacc

SEQ ID NO: 4341 - DNA, 848 bp, Artificial Sequence
  Synthetic polypeptide
atgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctgggggtggggacctcactggatgcacaatgttatgtctgtgctttcctgagcagaggatccctaaatttcattatattttaaaagacatctgtgacc

SEQ ID NO: 4342 - DNA, 198 bp, Artificial Sequence
  Synthetic polypeptide
atgtcgtccgacttcgaaggttacgagcaggacttcgcggtgctcactgcagagatcaccagcaagattgcgagggtcccacgactcccgcctgcacatcttattttctatgctagactgtcaactatgtgaaggtgggagctgtgtctgatttccttggcgtttacttattaggggctcaggaaaataagtgaatga

SEQ ID NO: 4343 - DNA, 1866 bp, Artificial Sequence
  Synthetic polypeptide
atgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggatactggggtccttttcccactcttccactgacttgctgtgtgaccttaggaagtctctgcccctctctcagcctcagtgtcc

SEQ ID NO: 4344 - DNA, 1986 bp, Artificial Sequence
  Synthetic polypeptide
atgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagtacagtggccattcgctggcccctcacaggcctggctggggagatgcacggagaatggagaatgtccccaggcctgggagctcagggtgtccgtcctcctcgctcagggcccgggacctgggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggatactggggtccttttcccactcttccactgacttgctgtgtgaccttaggaagtctctgcccctctctcagcctcagtgtcc

SEQ ID NO: 4345 - DNA, 216 bp, Artificial Sequence
  Synthetic polypeptide
atgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtggaggaggaggaagaggagaaggaaaagtgacgaagagagaggaggaggggg

SEQ ID NO: 4346 - DNA, 249 bp, Artificial Sequence
  Synthetic polypeptide
atggtagcaggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtggaggaggaggaagaggagaaggaaaagtgacgaagagagaggaggaggggg

SEQ ID NO: 4347 - DNA, 92 bp, Artificial Sequence; identical to SEQ ID NO: 1765
  Synthetic polypeptide

SEQ ID NO: 4348 - DNA, 531 bp, Artificial Sequence; identical to SEQ ID NO: 2507
  Synthetic polypeptide

SEQ ID NO: 4349 - DNA, 294 bp, Artificial Sequence; identical to SEQ ID NO: 2508
  Synthetic polypeptide

SEQ ID NO: 4350 - DNA, 316 bp, Artificial Sequence; identical to SEQ ID NO: 2509
  Synthetic polypeptide

SEQ ID NO: 4351 - DNA, 1648 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagggg

SEQ ID NO: 4352 - DNA, 425 bp, Artificial Sequence
  Synthetic polypeptide
atgtgtggaactggggggactgattccaagacaaggcgcccaccccacagagcaagttttctgaaacgtttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggagaggggagggga

SEQ ID NO: 4353 - DNA, 335 bp, Artificial Sequence
  Synthetic polypeptide
atggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggagaggggagggga

SEQ ID NO: 4354 - DNA, 916 bp, Artificial Sequence; identical to SEQ ID NO: 1226
  Synthetic polypeptide

SEQ ID NO: 4355 - DNA, 268 bp, Artificial Sequence
  Synthetic polypeptide
atgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggattgcttgaggccaggagttcaagaccagcctgggcaacacagcaagatcctgtctttgtaaaaaa

SEQ ID NO: 4356 - DNA, 226 bp, Artificial Sequence
  Synthetic polypeptide
atgtacctgcaggtggagacccgcaccagctcccgcctccatctgaagagggctccaggcatccggtcctggtccctgctggttgatagcctgggctggaagctcttctacgtcacaggctgcctgtttgtggctgtgcagaacttggaggactgggaggattgcttgaggccaggagttcaagaccagcctgggcaacacagcaagatcctgtctttgtaaaaaa

SEQ ID NO: 4357 - DNA, 264 bp, Artificial Sequence
  Synthetic polypeptide
atgtacctgcaggtggagacccgcaccagctcccgcctccatctgaagagggctccaggcatccggtcctggtccctgctggaatcttgtcgattggcctggctgctgcctactacagcggagatagcctgggctggaagctcttctacgtcacaggctgcctgtttgtggctgtgcagaacttggaggactgggaggattgcttgaggccaggagttcaagaccagcctgggcaacacagcaagatcctgtctttgtaaaaaa

SEQ ID NO: 4358 - DNA, 3308 bp, Artificial Sequence; identical to SEQ ID NO: 428
  Synthetic polypeptide

SEQ ID NO: 4359 - DNA, 3203 bp, Artificial Sequence; identical to SEQ ID NO: 429
  Synthetic polypeptide

SEQ ID NO: 4360 - DNA, 2849 bp, Artificial Sequence; identical to SEQ ID NO: 430
  Synthetic polypeptide

SEQ ID NO: 4361 - DNA, 388 bp, Artificial Sequence; identical to SEQ ID NO: 431
  Synthetic polypeptide

SEQ ID NO: 4362 - DNA, 1064 bp, Artificial Sequence
  Synthetic polypeptide
atggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctactacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgcagtgagccaggattgtgcgactgcactccagcctgggtgacagggtgaaacgccatctcaaaaaataaaaattgaaaaataaaaaaagaa

SEQ ID NO: 4363 - DNA, 1477 bp, Artificial Sequence; identical to SEQ ID NO: 3404
  Synthetic polypeptide

SEQ ID NO: 4364 - DNA, 232 bp, Artificial Sequence
  Synthetic polypeptide
atgcggcggcgctcgcggatgctgctctgcttcgccttcctgtgggtgctgggcatcgcctactacatgtactcggggggcggctctgcgctggccgggggcgcgggcggcggcgccggcaggaagctccagactctgtgctctgttctgcagtgttggagctaggaccgcacatcccagctgctttgccagtggcttccgggccacctccatcagcaggaggcggtagaag

SEQ ID NO: 4365 - DNA, 592 bp, Artificial Sequence; identical to SEQ ID NO: 1275
  Synthetic polypeptide

SEQ ID NO: 4366 - DNA, 180 bp, Artificial Sequence; identical to SEQ ID NO: 2259
  Synthetic polypeptide

SEQ ID NO: 4367 - DNA, 7808 bp, Artificial Sequence; identical to SEQ ID NO: 1143
  Synthetic polypeptide

SEQ ID NO: 4368 - DNA, 1874 bp, Artificial Sequence; identical to SEQ ID NO: 1144
  Synthetic polypeptide

SEQ ID NO: 4369 - DNA, 400 bp, Artificial Sequence
  Synthetic polypeptide
atggccctcaagatggtgaagggcagcatcgaccgcatgttcgacaagaatctgcaggacttggtccgcggcatccgtaaccacaaggaggacgaggccgggcgcagtggctcatgcctgttatcctggcactttgggaggctgaggcgagcagatcacctgaggtcaggaattcgagaccagcctggccaacgtggcgaaaccccgtctctaccaaaaatacaagaattagctgggcatggtggtgtgcccctgtaatcctagctactcaggaggctgagccaggagaatcacttgaacctgggaggtgaaggttgcagtgagccgagattgtgccactgcactccagcctggcatcagagcgagactccgtctcaaaaaaaaaaaaaaaaaaaaaaga

SEQ ID NO: 4370 - DNA, 763 bp, Artificial Sequence; identical to SEQ ID NO: 261
  Synthetic polypeptide

SEQ ID NO: 4371 - DNA, 646 bp, Artificial Sequence; identical to SEQ ID NO: 262
  Synthetic polypeptide

SEQ ID NO: 4372 - DNA, 662 bp, Artificial Sequence
  Synthetic polypeptide
atgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccaggtatacactcaagagaactgaaaacaagtgctcaagcagaaacttgtacatgaatgttcatcccatcattattcacaatagccaaaaaattgaaacagcccaaatgctcatcagccaatgagtggagaaacaaaacatggtaagtcatacaaagaatgaagtgctgattaatgatacagtcatggaggaactttaaaaacattgtgctacataaaagaaaccagacaccaggccacatattcaacaaggccatttatatgaaatatccagaataagcaaatgcatagacacaggcagcagatgactgattgccaggggctgaggagaaaaaggggaatggtgagtgacagcttaatgggtatcgattgcttttgaggatgatgaaagttctggaattagatggtggtggtgggttgcataacatagtgaatgtattaaaagccactaaattgtataatttaaggtggttaaaatggattttatgttctatgaatgttacctcaataaaaa

SEQ ID NO: 4373 - DNA, 1065 bp, Artificial Sequence
  Synthetic polypeptide
atggcccgggagaggccgcccgggaggggctgcggcgtcctgcgccggtgtctactcggggctgtgctgttgttcggcctgcggctctgcgcagagctgcggcgcgccgggcccgggtcccccacccgcagcgccccgccgggcccggcctggcggccacctgggccgcacctgccgcccgcgccgggccagccgcgcggcgccagcaggaggcaggtgacctacgtgcgcagcggtcgccgggcgccgccggggggcggcgggagcgggacgccggagcctggctgctgtgccccgcgcgggcgcccccgccggaagggtccccggtggcatatagatctccagccttgggcaggctctgctcagtccctggatgaagaagcctggaggttcctgagatatatcagcaccacccagattgcatgcaatcacatgaatacagacagcctggctactgactctagtcctacacacaagccctggtcagtgtgtcttgacgacaggttcaatttagctcatcaaatccgcaacaagcagtgccgcctctactccttagggctaggaagtgatgatacccattttgaggttagcatggccaacaacggatgtgaagtgcatcgttttgatcctagtgtcaagtcagctcacattctggagagtcagcacctttggtatcaccgcttgtccattgactggcgggatccccatccagctgttgctgcccaaaaaccacatagcaacaccagaaaactgggaagcattttgaatgaatttggacatcacaagattgacgttctcaaggcagatctggaaagtgcagaatggaaagttttggaaaatcttattctggaagatgttcttgagcagattggacagctcatctttgagatccatctccactggcctgggtttgagaaggatgtgtttgcttccccttccaccacgactgtaagtttcctgaggcctcgccagccatgctaaactgtgagtcaattaaatctctttcctctataaattactcagtctcaggtatatcttcatagcagtgtgagaatggactaatac

SEQ ID NO: 4374 - DNA, 298 bp, Artificial Sequence; identical to SEQ ID NO: 190
  Synthetic polypeptide

SEQ ID NO: 4375 - DNA, 316 bp, Artificial Sequence; identical to SEQ ID NO: 191
  Synthetic polypeptide

SEQ ID NO: 4376 - DNA, 211 bp, Artificial Sequence; identical to SEQ ID NO: 193
  Synthetic polypeptide

SEQ ID NO: 4377 - DNA, 439 bp, Artificial Sequence; identical to SEQ ID NO: 198
  Synthetic polypeptide

SEQ ID NO: 4378 - DNA, 301 bp, Artificial Sequence; identical to SEQ ID NO: 199
  Synthetic polypeptide

SEQ ID NO: 4379 - DNA, 478 bp, Artificial Sequence; identical to SEQ ID NO: 200
  Synthetic polypeptide

SEQ ID NO: 4380 - DNA, 11108 bp, Artificial Sequence
  Synthetic polypeptide
atgactgcctggctgatctctctgatgagtattgaagtactacttttggcagtacgtcacctgagtttacatattgaacctgaagaaggtagccttgcagggggaacgtggatcacagtcatttttgatggtttggagttgggtgttctttaccccaacaatggctctcaattggagatacacctggtgaacgtgaacatggtggtgcccgcactgcggagtgttccctgtgacgtctttcctgttttcttggatttgcctgtggtgacatgccggaccagatctgtgctgtctgaagcacatgagggtctgtacttcctggaagcatacttcgggggacagctggtaagcagtccaaatccaggaccacgagatagctgtactttcaagttttccaaggcgcagacacccatcgttcaccaagtttatccaccaagtggtgttccaggaaaactaatacatgtatatggctggattatcactggaagattggaaacttttgattttgatgctgagtacattgatagcccagtgatcttggaagctcaaggagacaaatgggttactccttgctctcttataaataggcagatgggaagctgttatcctattcaggaggaccatggtcttgggactctgcagtgccatgtggaaggcgactacatcggctcccagaatgttagcttctcagtatttaacaaaggaaagtcaatggtccacaagaaggcatggctgatcagtgctaaacaggatcttttcctataccagacacactcagaaatattatctgtgtttccagaaactgggagccttgggggaagaacaaacatcacaattacaggagacttttttgacaattctgcccaggttaccattgcaggcattccatgtgatattagacacgtgtctcccaggaagattgagtgcaccactcgggctccaggaaaagatgtgaggctcaccacccctcagccaggcaatcgagggcttctttttgaagttggagatgctgttgagggactggaactgactgaagccaccccagggtacaggtggcagattgtccctaatgccagttctccatttgggttttggtcacaggaaggacaacctttcagagcacggctcagtgggttctttgtggctccagagacaaataattacactttctggattcaggcagatagccaagcttccttgcatttcagttggtcagaggaaccaaggactaaggtgaaagtggcctccatcagcgtcggcactgctgactggtttgactcctgggagcagaatagggatgaagggacctggcagcagaagactcccaagttggagctgttgggtggagccatgtactacctggaagcagagcatcatgggatagccccaagcagggggatgaggattggtgtccagattcacaacacctggctgaatcctgatgtggtcaccacttacctacgggagaagcaccagatccgagtccgagcccagaggcttccagaagtacaggtgctgaatgtatcaggcagaggaaacttcttccttacttgggacaatgtctctagtcagccaatccctgcaaatgccacagcccatctgattcaaacaaccattgaggagttacttgcagtaaaatgcaaactggaacccctttggtctaacatccttctccggcttggatttgaacgaggcccagaagtttccaactctgatggggacctcaccagtgggacggagcccttctgtggcaggttcagcctccgtcagcctcgacaccttgtccttactcccccggctgcccagaagggctatcggctagatcagtatacacacctgtgtcttgcatacaaaggccacatgaacaagatcctgaagatgattgtgtccttcacaatcggctttcaaaacatggtaaagaataccacctgtgactggagtctcacgaggaccagccccgagagctggcagttcgattgcactgacctctgggagacttgtgtgcgttgcttcggggatctccagccccctccggcaaactccccagtgctggttcatcagatcaaccttctccctctggcccaggagacgggcctgttctatgtggatgaaattattattgcagacacaaacgtaacagtttctcaagctgattctggaacggctcgcccagggggcaatctggtggaatcagtctctgtggtgggatcccctccggtctacagtgtcacctcctggctggcggggtgtggcacggagctcccgctcatcactgcacgctctgtgcccactgaaggaacagaagagggatctggactggtcctggtgacgacacagagacgacagcggacaagtccacctctaggaggacactttcgcatccagcttcctaatacagtgatttctgatgtccctgtacaaatttctgctcatcaccttcaccagctcttacagaataatgccgatgacttcacatccaggtacctcaatgccagtgacttcactgtgaaggaggatctatacacttgctacgaacacgtgtggaccttgtcctggtccactcagattggggatttgcccaattttatcagggtctctgatgaaaaccttactggagtgaatcctgctgcagccacgcgtgtggtatatgatggtggagtttttcttggacccatatttggagacatgttggctactgccaaccagcatactcaggtggttgtgcgagtgaatgatgtaccagctcattgcccaggttcctgctctttccagtacctccaagggtcaactccctgtgtccattctgtgtggtactccattgatggtgacatcaacctaatgatttacattaccggaactggtttctctggtgactcccagttcttgcaggttacagtgaacaaaacgagttgcaaagttattttctcaaaccagaccaatgtagtctgtcagacagatttgctacctgttggaatgcatcggatcttgatgttggtgagaccctctggtcttgccatcagtgccactggagaagacctcttcctaaatgtgaaacctagactggatatggtggagccttccagagctgcggatattggagggctctgggccaccatccgaggctctagtttggaaggtgttagcctgatattatttggatcttactcgtgtgccatcaatgtcgctacaagcaattcaagcagaattcagtgcaaagttccacccagggggaaagatggacgcattgtgaatgtgactgtgatcagaggggactattctgcagttcttcccagagcatttacatatgtctcttccttaaatccagttattgtgactctgagcagaaacataagcaatatagcaggcggtgagaccctggtcattggagtggcgaggctgatgaactatacggatttggatgtggaagtccacgtccaggatgccttggctccggttcacacacagtcggcttggggcctggaggtggcactgcccccactgccagctggtctccacagaatttccgtctctatcaatggggtcagcattcactcacaaggggttgatctccacatccagtacctcacagaagttttcagcatcgagccttgctgtgggtccctgctgggagggaccatcctcagcatctcaggaataggcttcagcagggacccagctttggtttgggtacttgtgggcaatcggtcctgtgacattgtgaacttaacggaggcgagcatctggtgtgaaaccctgccagccccccagatacccgatgcgggcgctcccactgttccagctgccgtggaggtctgggctggcaacaggttcttcgcccgtggtccttcaccaagcttggtggggaaaggcttcaccttcatgtatgaagcggcagcaacaccagtagtcactgccatgcaaggagaaatcacaaatagcagcctgagcctgcatgtgggaggaagtaacctctccaactcagtcatccttctggggaacctgaactgtgatgttgagacacagtccttccagggcaacgtgagcctgtctggatgctccatccctcttcacagtctggaggctggcatctatcctctccaagtacgtcagaagcagatgggatttgctaatatgtctgtggtgctccagcaatttgcagtgatgcctcggataatggccatcttcccatcgcagggttcggcatgtggtgggaccatacttactgtgagggggttgcttcttaactctagaaggaggtcagttcgggttgacctctcgggtccttttacttgtgtgattttgagtttgggagaccacaccattctctgccaggttagcctggagggtgaccccttgcctggagcttccttctccctgaacgtcacagtcctggtcaatgggctaaccagcgagtgtcaggggaattgcactcttttcataagggaagaggcaagtcctgtcatggatgccttgtccacaaacaccagtgggtctctgaccactgtgctgattaggggtcagaggttagccaccacagctgatgagccgatggtatttgtggatgatcaacttccttgcaatgtaactttttttaatgcaagccacgttgtgtgccagacaagagacttggccccaggaccccactacctgtcagttttttatacaagaaatgggtatgcttgttctggtaatgtttccagacacttctacattatgccccaagtgtttcattattttcctaagaatttcagcttacatggtggaagcctcttgaccatagagggcacaggcctgagaggacagaacaccacgtcagtctatattgaccagcagacctgcctgacggtgaacatcggtgctgagctcatccggtgcattgttcccacagggaatggctctgttgccctggaaatagaggtagatggactttggtatcacataggagtcattggttataacaaggcctttaccccagaattgatctctatttctcagagcgatgacatcttaacctttgcagtggcccagatctcaggagctgcaaacattgacatttttataggaatgtcaccctgtgtgggtgtctctggtaaccacaccgttcttcagtgcgtggtcccttcccttccggccggggagtaccacgtcagaggctatgactgcatcagagggtgggcctcatctgccctggtgttcacctcaagagttattattacagcagtgacggagaacttcggctgcctgggtggaaggctggtgcatgtgtttggagcgggattttctccagggaatgtctcagctgctgtgtgtggtgctccctgccgagtcctggctaatgctacagtgtctgccttcagctgcttggttctgcccctggatgtgtccttggccttcctgtgtggcctgaagcgtgaggaggacagctgtgaggctgccagacacacctatgtgcagtgtgatttgacagttgccatggcgacagagcaactgcttgaatcgtggccttacctctacatttgcgaggaaagttcccaatgcctctttgtgccagatcattgggcagagtcaatgtttccatcattctcgggcctctttatcagccctaaattggaaagagatgaagttctcatctataatagctcctgtaacattaccatggaaactgaggcagagatggagtgtgagacgcccaatcagccaattaccgtcaagattactgagatacggaaacgctggggccagaacactcagggcaacttttctttacagttctgccggagatggtccaggactcacagctggtttcctgaaaggctgccacaagatggcgacaacgtcacagtggagaatggccaattgcttctgctggacactaacacaagcatcctcaacttactgcacattaaagggggcaagctgattttcatggccccaggacccatcgagctcagggcacacgccatccttgtttctgatggtggagagctccggattggatccgaagacaagcccttccaaggcagagctcagatcacactctacgggagttcctactcaactcccttctttccctatggagtcaagttcctggctgtgaggaatggaactctttctctgcacggttcactaccagaagtaattgtcacctgtcttagagcaactgcccatgccctagacacagtgctggctttagaagatgctgtggactggaaccctggggatgaagttgtcatcatcagtggaacaggtgttaaaggtgccaaaccgatggaagagattgtcactgtggaaactgtgcaggatacagacctctatcttaagtcacctttgagatattctcacaactttacagagaattgggtggctggagagcaccatattttaaaggccactgtggctctgctcagcaggagtattaccatacaaggaaatctcactaatgagagggagaagctgcttgtttcatgccaggaggccaatgctccagaaggtaatctgcagcactgtttgtattccatgagtgagaagatgctaggatccagggatatgggagccagagtgatcgttcagtccttcccagaagagcccagccaggtccagttgaagggagtgcagtttcaagtcttggggcaagccttccataagcatctgagctcactcactctggtgggagctatgagagagtctttcatacagggctgcacagtgaggaactccttcagtagaggcctcagcatgtgcgggaccttgggcctgaaggtggacagtaatgtattctacaatattttaggtcatgcgctgctagttgggacatgcacggagatgagatatatctcctgggaggcaattcatggaaggaaagatgactggtcaggacatggaaatataataagaaacaacgtgatcatccaggtttctggtgccgagggactctccaatcctgaaatgttgacaccatctggcatctatatctgcagtcccaccaatgttatagaggggaacagagtgtgtggtgctggctatggctactttttccatctcatgaccaaccaaacatcacaagctccgcttctttccttcactcagaacattgcacattcttgtaccaggtatggtctctttgtataccctaaatttcagccaccttgggataatgtcactggcaccactctgttccagagcttcacagtttgggaaagtgcaggtggtgcccagatttttagaagtagcaatcttcgcctgaaaaacttcaaagtttattcatgcagagattttggaattgacgtcttggaaagtgatgcaaatacttcagttactgacagcttattacttggtcattttgcccacaagggaagtctgtgtatgtcatctgggattaaaactcctaaaagatgggaactgatggtgtctaacacaacctttgttaattttgatctcatcaactgtgtggccattagaacctgttcagactgttcccaaggacaaggtggatttactgtgaagaccagccagttgaagtttacaaactcttcaaacttagtggcatttccatttcctcatgcagcaattttggaagacttggatgggtctctgtctgggaaaaacagaagtcacattcttgcttctatggaaaccctttcagcttcttgtttggtcaattcaagctttggtcgggttgtccatggcagtgcctgtggaggaggtgttctttttcatcgtatgtctattggtttagcgaatactcctgaagtttcttatgatttaaccatgactgacagcagaaataaaacaaccactgtcaattatgtacgtgatacattgtctaaccctcgtggctggatggctctgctcttggaccaagagacctactcattgcaatctgagaacctttggatcaacagatctctgcagtactcagcaacctttgacaactttgctcctggtaattacctactgctggtgcacacagatttgccgccttaccctgacatcctcctaagatgtgggagtcgagtgggtctgtcttttccatttcttccatcaccaggtcagaaccaaggctgtgactggttcttcaatagccagctgaggcaactcacctatctggtttcaggtgaaggccaagttcaagtcattctccgggtgaaggaaggtatgcccccaactatttcagcttctacctctgcccctgaatcagctttaaaatggtccctccctgaaacatggcaaggtgttgaagaaggctggggaggatacaacaataccattccaggccctggggatgacgttctcattttacccaacagaactgtccttgtggatacagatcttccattcttcaaagggctgtatgtgatggggaccttagacttccctgtggacagaagcaatgttctgagtgtggcatgcatggtcattgcaggcggggagctgaaagttggtactttagaaaatcccttagaaaaggaacaaaagcttctgattctccttagagcctcagagggagtcttttgtgaccgtatgaatggaattcatattgacccaggaacaattggggtttatgggaaagttcatctttacagtgcttatcctaagaactcctggacacatcttggagctgatattgcctcaggaaatgagagaattatagtagaagatgcagtggattggcgcccccatgacaaaatagtccttagctcctcttcttatgagcctcatgaagcagaggtcctcactgtgaaagaagtcaagggccaccatgtgaggatctatgaacggctcaaacaccggcatattggaagtgtacatgtcacggaggatggccgacacattcgtttggctgctgaggttggactgttgacccgaaatatacaaattcagcctgacgtatcatgtagggggagactgtttgtggggtccttcaggaagtccagccgagaagaattttcaggtgtccttcaacttcttaatgtggaaattcagaacttcgggtcaccattgtactcatctgttgaattcagtaatgtgtcagcaggatcctggatcatatcatctactctgcaccagagctgtggcgggggcattcatgcagctgccagtcatggagtacttttaaatgacaatattgtgtttggcacagctggccatggcatagatttagagggtcaggcctatactgtcactaataaccttgtggttctgatgacacagccagcgtggtccaccatttgggtggcgggaatcaaagtgaaccaggtaaaggacatcaacctccatggcaacgttgtggcaggatcagagagacttggctttcacatccgaggccacaagtgctcctcttgtgaactgctttggtctgacaatgtggcgcattcaagtcttcatggccttcatctctataaggaaagtggacttgacaactgtaccagaatctctggcttcttggctttcaagaactttgactatggtgccatgttacatgtagagaacagcgtggagatagagaacattactctggtagacaatactattggtcttttggcagtagtgtatgtattttctgctccacaaaattccgtcaaaaaagtgcagattgtgcttaggaattcagtcattgtggccaccagctcttcttttgactgcattcaggacaaagtgaagccgcactcagccaacttgacatcaacagatagagctccctccaatccaagaggaggtcgaattggtattctgtggcctgtattcacctcagaaccaaatcagtggcctcaggagccatggcacaaagtgaggaatgatcattcaatttcaggaatcatgaaacttcaagatgttaccttttctagttttgtgaagagttgctatagcgatgacctggatgtctgcattctaccaaatgcagagaacagtggaattatgcacccaataacagcagagaggaccaggatgctaaagataaaagataaaaacaagttctactttccttcattacaacccaggaaagatttaggaaaagtagtctgtcctgaattagactgtgcaagtccaagaaaatatctcttcaaggatctggatgggagagccctgggtctgcctccaccagtttctgtatttcctaaaacagaggcagaatggactgcatccttcttcaacgcaggaccaagactgaaataccatcaaatgctgatgacttccaatttatatcctcagcctagactcgaccctgaaatttggtctagtatagccaactgactttacttggaaagatagtagacatctcagactcaatatgcctcaaaaagattcttgatctcttccccaatctacaacctgcttcttgcctagctgtccctacctcagtaattggtgccaccattcattaggctatttaagtaaaaaacctgggagtcatcttttatttttctttttcctaacccaaattctcaaacttctcatttcctccactactaccaccctcaccattccctttactactagccaccattgtctctcactagatgagggaatagcctccttgctggtcttctttcttctacttttgtagtctctagtctattcttcacacatggccagagggatattttcagctttccacccattcagaatgaagtcccagctacaagcctgtaagtcttgtagcccctggttcctgcccactctctcacctcctctcttgtgacacgccttttacttacttatcctggtctcttatttttcgtttaacatggtatgtgtatcactacatcagggcgtttgtgctggctttttcctcttcctggaatattttattctcacttctttgggagctagttcccgctgttcaaataaggtaccctcagagaagccatccttgaccaccctatctaaaataatcatgagatcatttttctgtagctctactgtgcttgctttattgtttgttagagtcgtggtacttaacattatattataaatgtaattgcttatgttaatgtactgtttatcctttttagaacacaaacttcatgagggcaggattttttttttgttgttcactgatgtgtatttgggggttactcaataaattttggttgactgatcaaatgaat

SEQ ID NO: 4381 - DNA, 479 bp, Artificial Sequence
  Synthetic polypeptide
atgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagaggattacttgagcccaggaatttgagaccagcttgggcaacataggaagaccggtctctactaaaaaaagaaaccaaacaaacaaattagctgggcatagtgacgcacacctgtagtcccagccagctacttgtgaggctgaggtgggacaattgcttgagcccaggtgttcaagactgcagtgagccctgattgtgaca

SEQ ID NO: 4382 - DNA, 473 bp, Artificial Sequence
  Synthetic polypeptide
cttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacatgcttatttaccgtgtcaaaacagagaagtgaacttcgactatgattataaagcacagtggagtggagatttttattgtaggaattacaaagcaaagtactaaactgacactgtaggtaagctaataatatacatccacattaccggactataatcacttatcacaactgtcacatgttctcaaactgacaggaaagcaactgtcagaaaaattataacctttagaaatggaatattagatcccagcagaattttttcacaaaaattaatgaaagtgaggc

SEQ ID NO: 4383 - DNA, 1003 bp, Artificial Sequence
  Synthetic polypeptide
atggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacatgcttatttaccgtgtcaaaacagagaagtgaacttcgactatgattataaagcacagtggagtggagatttttattgtaggaattacaaagcaaagtactaaactgacactgtaggtaagctaataatatacatccacattaccggactataatcacttatcacaactgtcacatgttctcaaactgacaggaaagcaactgtcagaaaaattataacctttagaaatggaatattagatcccagcagaattttttcacaaaaattaatgaaagtgaggc

SEQ ID NO: 4384 - DNA, 724 bp, Artificial Sequence
  Synthetic polypeptide
atgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacatgcttatttaccgtgtcaaaacagagaagtgaacttcgactatgattataaagcacagtggagtggagatttttattgtaggaattacaaagcaaagtactaaactgacactgtaggtaagctaataatatacatccacattaccggactataatcacttatcacaactgtcacatgttctcaaactgacaggaaagcaactgtcagaaaaattataacctttagaaatggaatattagatcccagcagaattttttcacaaaaattaatgaaagtgaggc

SEQ ID NO: 4385 - DNA, 622 bp, Artificial Sequence
  Synthetic polypeptide
atggcggagtacgacttgactactcgcatcgcgcactttttggatcggcatctagtctttccgcttcttgaatttctctctgtaaaggaggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacatgcttatttaccgtgtcaaaacagagaagtgaacttcgactatgattataaagcacagtggagtggagatttttattgtaggaattacaaagcaaagtactaaactgacactgtaggtaagctaataatatacatccacattaccggactataatcacttatcacaactgtcacatgttctcaaactgacaggaaagcaactgtcagaaaaattataacctttagaaatggaatattagatcccagcagaattttttcacaaaaattaatgaaagtgaggc

SEQ ID NO: 4386 - DNA, 1363 bp, Artificial Sequence
  Synthetic polypeptide
atgtgggagaaaatggagaccaagacgatcgtgtacgacttggacacatcaggggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaagatatctcaggatgaacctcctccataagaccagaagtcttctgcctctccacatctgctcttcctcctgtatctcctattgcagtaaataacaatgatcactactcagtccctcaaactaaaattctgggaaccattttcagttctcccttgtctaccataaggattttgtcaccaaatctgttggttctctggatgttttccaaatccacaaagtgctatcacatctc

SEQ ID NO: 4387 - DNA, 465 bp, Artificial Sequence; identical to SEQ ID NO: 3964
  Synthetic polypeptide

SEQ ID NO: 4388 - DNA, 1026 bp, Artificial Sequence; identical to SEQ ID NO: 2114
  Synthetic polypeptide

SEQ ID NO: 4389 - DNA, 441 bp, Artificial Sequence
  Synthetic polypeptide
atgagcggcttcagcaccgaggagcgcgccgcgcccttctccctggagtaccgagtcttcctcaaaaatgagaaaggacaatatatatctccatttcatgatattccaatttatgcagataagggacatggatgaagctggaaaccatcattctcagcaaactgttgcaaggacaaaaaaccaaacaccgcatttctcactcataggtgggaattgaacaatgagaacacgtggacacaggaaggggaacatcacacaccggggcctgttgtggggtggggggagggggaaaggatagtattaggagatatacctaatgctaaatgatgagttaatgggtgcagcacaccaacatgcaacatggcacatgtatacatatgtaacaaacctgcactttgtgcacatataccctaaaacttaaagtataataataaaaaaaaa

SEQ ID NO: 4390 - DNA, 288 bp, Artificial Sequence
  Synthetic polypeptide
atggggtctcggttgtcccagccttttgagtcctatatcactgcgcctcccggtaccgccgccgcgcccgccaaacctgcgcccccagctacacccggagcgccgacctccccagcagaacaccgcctgttgaagacctgctggagctgtcgcgtgctttctgggttggggctgatgggggcgggcgggtacgtgtactgggtggcacggaagcccatgaagatgggataccccccgagtccatggaccattacgcagatggtcatcggcctcagtattgttgttttt

SEQ ID NO: 4391 - DNA, 1519 bp, Artificial Sequence
  Synthetic polypeptide
atggatgatgtcctgcccctgatgccttgggagaccctgttggcacagggcagtccccagggctcgcctgacctcccagcagggcagcggaagcagcagccacagggtgacagggcccagggcctggcctctgagtcctggaagctcctggaggtgcccatcattcacataacgccatccagtgatggggagtcccccgcctgcaccccaaccccccgacgccggcagcagcagaggatgccagacccgcagagtctgtcccaggacagcaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcatggcagggtgaacacaagcacagactgaaggcagcttgccgcggttcacatcctggtcacaccacttcctgaccatgtcacgtgggcaaattatgtaacttctctgagcttgctttcctcctctgaaaatggggttaacaatgataatacccacttcataggattgttgttaagagactataaatga

SEQ ID NO: 4392 - DNA, 1258 bp, Artificial Sequence
  Synthetic polypeptide
atgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcatggcagggtgaacacaagcacagactgaaggcagcttgccgcggttcacatcctggtcacaccacttcctgaccatgtcacgtgggcaaattatgtaacttctctgagcttgctttcctcctctgaaaatggggttaacaatgataatacccacttcataggattgttgttaagagactataaatga

SEQ ID NO: 4393 - DNA, 556 bp, Artificial Sequence
  Synthetic polypeptide
atgcactgcttgaaaaggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcatggcagggtgaacacaagcacagactgaaggcagcttgccgcggttcacatcctggtcacaccacttcctgaccatgtcacgtgggcaaattatgtaacttctctgagcttgctttcctcctctgaaaatggggttaacaatgataatacccacttcataggattgttgttaagagactataaatga

SEQ ID NO: 4394 - DNA, 1237 bp, Artificial Sequence
  Synthetic polypeptide
atgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcatggcagggtgaacacaagcacagactgaaggcagcttgccgcggttcacatcctggtcacaccacttcctgaccatgtcacgtgggcaaattatgtaacttctctgagcttgctttcctcctctgaaaatggggttaacaatgataatacccacttcataggattgttgttaagagactataaatga

SEQ ID NO: 4395 - DNA, 668 bp, Artificial Sequence
  Synthetic polypeptide
atggagaagcccctcttcccattagtgcctttgcattggtttggctttggctacacagcactggttgtttctggtgggatcgttggctatgtaaaaacagccgctacatctgttacttttgttggtgttatgggaatgagatcctactactatggaaaattcatgcctgtaggtttaattgcaggtgccagatggagtatggctcttgttgcccaagctggggtgcaatggtgcgatctcagctcattgcaacctccacctcccaggttcaagcgattctcctgccttaccctcctgagtagctgggatttcagaccctgcacttgatggatcacctggcaccgcccaaattgataaactggctcatctgatcttgtggcccccatccaggaactgactcagtgcaagacaacagcttgcactccctatgacttaatctcccaccggaccagtcagcactcctgagtcacctggctgcccctggcacaccaagtaacccttaaacacttcaatccttgaatgctctgggagactgatttgagtaccaataaaactccagtctcctgcacagctggctctgcgtgtgctctttctctattgcaattccctgtcttgataactcagctctgtctaggcaaagggcaaagtgaacccattgggccattaca

SEQ ID NO: 4396 - DNA, 770 bp, Artificial Sequence
  Synthetic polypeptide
atggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagatggagtatggctcttgttgcccaagctggggtgcaatggtgcgatctcagctcattgcaacctccacctcccaggttcaagcgattctcctgccttaccctcctgagtagctgggatttcagaccctgcacttgatggatcacctggcaccgcccaaattgataaactggctcatctgatcttgtggcccccatccaggaactgactcagtgcaagacaacagcttgcactccctatgacttaatctcccaccggaccagtcagcactcctgagtcacctggctgcccctggcacaccaagtaacccttaaacacttcaatccttgaatgctctgggagactgatttgagtaccaataaaactccagtctcctgcacagctggctctgcgtgtgctctttctctattgcaattccctgtcttgataactcagctctgtctaggcaaagggcaaagtgaacccattgggccattaca

SEQ ID NO: 4397 - DNA, 1767 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgggg

SEQ ID NO: 4398 - DNA, 661 bp, Artificial Sequence
  Synthetic polypeptide
atggcggcggtggtagctgctacggcgctgaagggccggggggcgagaaatgcccgcgtcctccgggggattctcgcaggagccacagctaacaaggcttctcataacaggacccgggccctgcaaagccacagctccccagagggcaaggaggaacctgaacccctatccccggagctggaatacattcccagaaagaggggcaagaaccccatgaaagctgtgggactggcctggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatga

SEQ ID NO: 4399 - DNA, 589 bp, Artificial Sequence
  Synthetic polypeptide
atggcttggcagggctggcccgcggcgtggcagtgggtcgccggctgctggctcctcctcgtccttgtcctcgtcctacttgtgagcccccgcggctgccgagcgcggcggggcctccgcggtctgctcatggcgcacagccagcggctgctcttccgaatcgggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatga

SEQ ID NO: 4400 - DNA, 481 bp, Artificial Sequence
  Synthetic polypeptide
atgccctcctcagtgcatcataccaagaggcaaatgatgtctatatattgttactggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatga

SEQ ID NO: 4401 - DNA, 926 bp, Artificial Sequence
  Synthetic polypeptide
atgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagccgggcgcggtggctcacgcctgtaatcccagcactttgggaggctgaggcgggtggatcacctgaggtcacgagttcagaaccagcctaaccaacatggcgaaaccctgtctctactaaaaactacaaaaatgagccaggcctggtggtttgtgcctatagtcccagctacttgggaggctgaggcaggagagttgcttggacccgggaggtggaggttgcagtgagctgagattgtgccactgcactccagcctgggtgacagaatgagactctgtgtcaaaaaaaaaaaaaaa

SEQ ID NO: 4402 - DNA, 1606 bp, Artificial Sequence; identical to SEQ ID NO: 327
  Synthetic polypeptide

SEQ ID NO: 4403 - DNA, 175 bp, Artificial Sequence; identical to SEQ ID NO: 329
  Synthetic polypeptide

SEQ ID NO: 4404 - DNA, 690 bp, Artificial Sequence; identical to SEQ ID NO: 145
  Synthetic polypeptide

SEQ ID NO: 4405 - DNA, 1216 bp, Artificial Sequence; identical to SEQ ID NO: 1380
  Synthetic polypeptide

SEQ ID NO: 4406 - DNA, 1155 bp, Artificial Sequence
  Synthetic polypeptide
atggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctactacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattct

SEQ ID NO: 4407 - DNA, 868 bp, Artificial Sequence
  Synthetic polypeptide
atggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctactacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattct

SEQ ID NO: 4408 - DNA, 7772 bp, Artificial Sequence
  Synthetic polypeptide
atgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttcaaggcggagcaggtctctctcttcaccacggtccaaagcaaaatctcgcttgtctttgaggcgcagcctttcagggtcttccccatgccctaaacaaaagtcacagacaccacccaggcgcagtcgctctggatcctcccaacctaaagctaaatctagaacgccacccagacgcagtcgctccagttcttctccgccacctaaacagaaatctaagacaccatcaagacaaagtcattccagttcatctcctcatcctaaagtgaaatctggaacaccaccgaggcaagggtccataacaagtccccaggccaatgagcaatctgtaacgccacagagacggagctgttttgaatcatcacctgaccctgagttgaaatctaggaccccttctagacatagctgctcagggtcctctcctcctagagtgaaatctagcacacctcccagacagagcccatctaggtcatcatctccacaacccaaagtgaaggcaataatatcaccaagacaaagaagccattctggctcctcttctccaagtcctagtagggtgacgtcgagaacaactccacggcgaagcagatcagtatctccctgctccaatgtggaatccagattgttgccaagatacagtcattctgggtcctcctcaccagataccaaagtgaaacctgaaacaccgccaagacaaagtcactcagggtctatttcaccataccccaaagtaaaggcccaaactccaccggggccaagtctttctggatcaaagtcaccatgtccccaagagaagtctaaagactcactagttcaaagttgccctggatccctctctctctgtgcaggagtaaaatctagcacaccaccaggcgagagctattttggtgtctcatctctgcaactgaaaggacaatctcaaacttcaccagaccacagatctgatacttcaagtccagaagtgagacagagtcattcagaatcaccatctctgcagagcaaatctcaaacatcacctaagggaggtcggtccaggtcttcatctccagtcactgagctggcatccagatctccaataagacaagatagaggtgagttctcagcgagtcctatgttgaaatctggaatgtctcctgagcagagcaggttccagtctgactcttcttcatatcctacagtggactcgaattctctcttggggcagagtagattggagactgctgaatcaaaagagaaaatggccttaccccctcaggaggatgctactgcatcacctcctagacagaaagacaaatttagtccctttccagtacaggataggcctgagtcttcactggtattcaaagacacacttagaaccccgccaagggaaagaagtggtgctgggtcatctccagaaacaaaagagcaaaatagtgcattgcctacgtcaagccaagatgaagagttaatggaggtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatctagagggagaagcgaatgtgattcttccccagaaccgaaagctttgcctcagactcctaggccgaggagtcgttctccatcatccccagagctcaacaacaagtgtcttaccccccagagagaaagaagcgggtcagaatcatcagttgatcagaaaactgtggctcggactcccctggggcagagaagtcgttcgggatcctctcaagaacttgatgtgaaacccagtgcatcccctcaggaaagaagtgagtcagactcttctccagattctaaagccaagacaagaaccccacttcggcagaggagtcggtctggatcatctccagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccagacgaagcagatcaggttcatcaagcaaaggcagaggcccttctcctgaaggaagcagcagtaccgagtcctctcctgaacatccgcccaaatccagaactgctcgcagaggttccaggtcatcaccagagcccaagaccaagtctcgtacaccacctcgacgtcgcagctctcgatcatctccggagctaacaaggaaggccagactgtcccgtagaagccgctctgcctcatcctcaccagaaactcgctctagaactcccccaaggcaccggagaagtccctcagtgtcttccccggagccagccgaaaaatcgaggtcttcacgccgacggcgctcagcttcatctccacgcactaagacaacctcaaggagaggccgctctccttcgccaaagcctcgtggactccagaggtcccgttcccgctcaaggagagagaaaacaagaacaacccgacgtcgagataggtctggatcttctcagtcaacctctcggcgaagacagcggagccggtcaaggtcgcgggttactcggcggcggaggggaggctctggttatcactcaaggtcacctgcccggcaggaaagttcccggacctcctctcgacgccgaagaggccgctctcggacacccccaaccagtcggaagcgttctcgctcacgcacatcaccagccccgtggaaacgctctagatctcgagcctctccagccactcaccggcgatccaggtccagaacccccctgataagccgacgtaggtccagatctcgaacttcaccagtcagccggagacggtcaaggtccaggacttcagtgactcgacgaagatcccggtcaagagcatccccagtgagcagaaggcgatccagatccagaacgccaccagtaacccgccgtcgttcaaggtctagaacgccaacaacacgccgccgctcccgttctagaactccaccagtgactcgcagaaggtccagatccaggactccaccagtaaccaggaggcgatctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagctattcggcgccgctctagatctcgaacgccactgttaccacgcaaacgttctcgaagtcgctcaccacttgctatccgccgccgctccagatcccgtactccacgaacagctcggggtaaacggtccttaacaagatctcctccagccatccgcaggcgttctgcatctggaagtagttctgatcgttcacgatctgctactcctccagcaacaagaaatcattctggttcacggacacctccagtagcactcaacagttccagaatgagctgcttcagtcgtcctagcatgtccccaacacctcttgatcgctgcagatcacctggaatgcttgaaccccttggcagctctagaacacccatgtctgtcctgcagcaagccggcggctccatgatggatggtccaggtccccgaatacctgaccaccagagaacatctgtgccagaaaatcatgctcagtccaggattgcacttgccctgacagctatcagtcttggcaccgctcggcctcctccgtccatgtctgctgctggccttgctgcaagaatgtcccaggttccagccccggtgcctctcatgagtctcagaaccgcaccagcagccaaccttgccagcaggattcctgcagcctctgcggcagccatgaacctagccagcgccaggacacctgccattccaacagcagtgaacctggctgactctcgaacgccagctgcagcagcggccatgaacttggccagccccagaacagcggtggcaccttcggctgtgaacctggctgaccctcgcactcccacagccccagctgtgaacctagcaggggccagaaccccagctgccttggcagctctgagtctcacaggctctggcacaccaccaactgctgcaaactatccctccagctccagaacaccacaggctccagcctctgcaaacctggtgggtcctcggtctgcacatgccacagctcctgtgaatattgccggctccagaaccgccgcagccttggcccccgcgagcctcaccagtgctaggatggctccagcattgtctggtgcaaacctcaccagccccagggtgcccctttctgcctacgagcgtgtcagtggcagaacctcaccaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagagcaggagggatggcagttagacctcaagaggaactccctg

SEQ ID NO: 4409 - DNA, 579 bp, Artificial Sequence
  Synthetic polypeptide
accaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagagcaggagggatggcagttagacctcaagaggaactccctg

SEQ ID NO: 4410 - DNA, 1307 bp, Artificial Sequence; identical to SEQ ID NO: 1904
  Synthetic polypeptide

SEQ ID NO: 4411 - DNA, 1421 bp, Artificial Sequence; identical to SEQ ID NO: 1905
  Synthetic polypeptide

SEQ ID NO: 4412 - DNA, 1325 bp, Artificial Sequence; identical to SEQ ID NO: 1906
  Synthetic polypeptide

SEQ ID NO: 4413 - DNA, 1403 bp, Artificial Sequence; identical to SEQ ID NO: 1907
  Synthetic polypeptide

SEQ ID NO: 4414 - DNA, 539 bp, Artificial Sequence; identical to SEQ ID NO: 1908
  Synthetic polypeptide

SEQ ID NO: 4415 - DNA, 1262 bp, Artificial Sequence; identical to SEQ ID NO: 1909
  Synthetic polypeptide

SEQ ID NO: 4416 - DNA, 832 bp, Artificial Sequence
  Synthetic polypeptide
atggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggaggaggatcatttatgcttgggaggtcgaggctgcagtgagtcatgattgtatgactgcactccagcctgggtgacagagcaagaccctgtttcaaaaagaaaaa

SEQ ID NO: 4417 - DNA, 910 bp, Artificial Sequence
  Synthetic polypeptide
atggccggggggccgggcccgggggagcccgcagcccccggcgcccagcacttcttgtacgaggtgccgccctgggtcatgtgccgcttctacaaagtgatggacgccctggagcccgccgactggtgccagttcggtgggtggcggcgggctgccggggggcgggaggcgcgcgggctcctggcgccgacgcctgacgccccccgccccgcagccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggaggaggatcatttatgcttgggaggtcgaggctgcagtgagtcatgattgtatgactgcactccagcctgggtgacagagcaagaccctgtttcaaaaagaaaaa

SEQ ID NO: 4418 - DNA, 143 bp, Artificial Sequence
  Synthetic polypeptide
gatgaggaacacggtgtatgctgtgaagaggctgaaggaggaggatcatttatgcttgggaggtcgaggctgcagtgagtcatgattgtatgactgcactccagcctgggtgacagagcaagaccctgtttcaaaaagaaaaa

SEQ ID NO: 4419 - DNA, 288 bp, Artificial Sequence
  Synthetic polypeptide
atggtcttgctgacttcaagaatgaagccgctgacctcgcgcataattagcatcatcattattctggctggagcaattgcactcatcattggctttggtatttcaggggtttctgcttttgcatctttctcattttctcttgccactgccatgtaagaagtgcctttcacctcccgccatgactctgaggcctccccagccatgtgaaactgttaagttcaattaaacctctttttcttccaagtctcgggtatttctttatcagcactgtgaaaatggactaataca

SEQ ID NO: 4420 - DNA, 279 bp, Artificial Sequence
  Synthetic polypeptide
atggcttccctggggcagatcctcttctggagcataattagcatcatcattattctggctggagcaattgcactcatcattggctttggtatttcaggggtttctgcttttgcatctttctcattttctcttgccactgccatgtaagaagtgcctttcacctcccgccatgactctgaggcctccccagccatgtgaaactgttaagttcaattaaacctctttttcttccaagtctcgggtatttctttatcagcactgtgaaaatggactaataca

SEQ ID NO: 4421 - DNA, 719 bp, Artificial Sequence
  Synthetic polypeptide
atggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctct

SEQ ID NO: 4422 - DNA, 596 bp, Artificial Sequence
  Synthetic polypeptide
atgggggcgggggaacagaacaggcaaagtgcccactgtgtgcagggcatatgcgggtacctggagggagatgaagaaggggaagagggggaggtgcgaagcactcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctct

SEQ ID NO: 4423 - DNA, 1806 bp, Artificial Sequence
  Synthetic polypeptide
atgaggtcctgcctgtggagatgcaggcacctgagccaaggcgtccagtggtccttgcttctggctgtcctggtcttctttctcttcgccttgccctcttttattaaggagcctcaaacaaagccttccaggcatcaacgcacagagaacattaaagaaaggtctctacagtccctggcaaagcctaagtcccaggcacccacaagggcaaggaggacaaccatctatgcagagccagtgccagagaacaatgccctcaacacacaaacccagcccaaggcccacaccaccggagacagaggaaaggaggccaaccaggcaccgccggaggagcaggacaaggtgccccacacagcacagagggcagcatggaagagcccagaaaaagagaaaaccatggtgaacacactgtcacccagagggcaagatgcagggatggcctctggcaggacagaggcacaatcatggaagagccaggacacaaagacgacccaaggaaatgggggccagaccaggaagctgacggcctccaggacggtgtcagagaagcaccagggcaaagcggcaaccacagccaagacgctcattcccaaaagtcagcacagaatgctggctcccacaggagcagtgtcaacaaggacgagacagaaaggagtgaccacagcagtcatcccacctaaggagaagaaacctcaggccaccccaccccctgcccctttccagagccccacgacgcagagaaaccaaagactgaaggccgccaacttcaaatctgagcctcggtgggattttgaggaaaaatacagcttcgaaataggaggccttcagacgacttgccctgactctgtgaagatcaaagcctccaagtcgctgtggctccagaaactctttctgcccaacctcactctcttcctggactccagacacttcaaccagagtgagtgggaccgcctggaacactttgcaccaccctttggcttcatggagctcaactactccttggtgcagaaggtcgtgacacgcttccctccagtgccccagcagcagctgctcctggccagcctccccgctgggagcctccggtgcatcacctgtgccgtggtgggcaacgggggcatcctgaacaactcccacatgggccaggagatagacagtcacgactacgtgttccgattgagcggagctctcattaaaggctacgaacaggatgtggggactcggacatccttctacggctttaccgccttctccctgacccagtcactccttatattgggcaatcggggtttcaagaacgtgcctcttgggaaggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccagaaagtaaggacgtgcttaaagaatggaacacatcaaaagaacacagaagccagcctgaagacgctcccactggctcaatacaagatgatttgagaatgaaaattggtaatgatggtaatgaatttcaacacattcaacaaatggtaatctaggagtccacactgatataaataaatacatacacacatacataagaaagaa

SEQ ID NO: 4424 - DNA, 1246 bp, Artificial Sequence
  Synthetic polypeptide
atggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctct

SEQ ID NO: 4425 - DNA, 1123 bp, Artificial Sequence
  Synthetic polypeptide
atgggggcgggggaacagaacaggcaaagtgcccactgtgtgcagggcatatgcgggtacctggagggagatgaagaaggggaagagggggaggtgcgaagcactcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctct

SEQ ID NO: 4426 - DNA, 384 bp, Artificial Sequence
  Synthetic polypeptide
atgctagagaacctggctctcatatcctcgctggatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagcccctacccgccaaattttgaaaactctgatcccagaatgctcagggagactgatttgaataataaaactcctgtctcccgaacagcaggacggctctgcgtgaattactatttctccatcgcaattccccagtcttcataaatcggctctgtctaggcagctggcaacgtgaacccactggacggttaca

SEQ ID NO: 4427 - DNA, 458 bp, Artificial Sequence
  Synthetic polypeptide
atgtggctgtgaacttttcccaggaggagtggtgtcttcttagtgaggctcagaggtgcttgtaccgtgatgtgatgctagagaacctggctctcatatcctcgctggatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagcccctacccgccaaattttgaaaactctgatcccagaatgctcagggagactgatttgaataataaaactcctgtctcccgaacagcaggacggctctgcgtgaattactatttctccatcgcaattccccagtcttcataaatcggctctgtctaggcagctggcaacgtgaacccactggacggttaca

SEQ ID NO: 4428 - DNA, 513 bp, Artificial Sequence
  Synthetic polypeptide
atggcagcggctgcgccgaggcgcccgactcagcagggcactgtgacctttgaagatgtggctgtgaacttttcccaggaggagtggtgtcttcttagtgaggctcagaggtgcttgtaccgtgatgtgatgctagagaacctggctctcatatcctcgctggatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagcccctacccgccaaattttgaaaactctgatcccagaatgctcagggagactgatttgaataataaaactcctgtctcccgaacagcaggacggctctgcgtgaattactatttctccatcgcaattccccagtcttcataaatcggctctgtctaggcagctggcaacgtgaacccactggacggttaca

SEQ ID NO: 4429 - DNA, 510 bp, Artificial Sequence
  Synthetic polypeptide
atggcagcggctgcgccgaggcgcccgactcagggcactgtgacctttgaagatgtggctgtgaacttttcccaggaggagtggtgtcttcttagtgaggctcagaggtgcttgtaccgtgatgtgatgctagagaacctggctctcatatcctcgctggatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagcccctacccgccaaattttgaaaactctgatcccagaatgctcagggagactgatttgaataataaaactcctgtctcccgaacagcaggacggctctgcgtgaattactatttctccatcgcaattccccagtcttcataaatcggctctgtctaggcagctggcaacgtgaacccactggacggttaca

SEQ ID NO: 4430 - DNA, 514 bp, Artificial Sequence
  Synthetic polypeptide
gtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgacctgggagcgtctcgagggcagggtccgggtctgactcgtctctatgtcccccacgcccggcccagggctggccacagagtaggtg

SEQ ID NO: 4431 - DNA, 769 bp, Artificial Sequence
  Synthetic polypeptide
atgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgacctgggagcgtctcgagggcagggtccgggtctgactcgtctctatgtcccccacgcccggcccagggctggccacagagtaggtg

SEQ ID NO: 4432 - DNA, 583 bp, Artificial Sequence
  Synthetic polypeptide
ggccgagggggctttggcgggggccgaggtcgaggcggaggctttagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgacctgggagcgtctcgagggcagggtccgggtctgactcgtctctatgtcccccacgcccggcccagggctggccacagagtaggtg

SEQ ID NO: 4433 - DNA, 697 bp, Artificial Sequence
  Synthetic polypeptide
atgaagccaggattcagtccccgtgggggtggctttggcggccgagggggctttggtgaccgtggtggtcgtggaggccgagggggctttggcgggggccgaggtcgaggcggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgacctgggagcgtctcgagggcagggtccgggtctgactcgtctctatgtcccccacgcccggcccagggctggccacagagtaggtg

SEQ ID NO: 4434 - DNA, 658 bp, Artificial Sequence
  Synthetic polypeptide
atgaagccaggattcagtccccgtgggggtggctttggcggccgagggggctttggtgaccgtggtggtcgtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgacctgggagcgtctcgagggcagggtccgggtctgactcgtctctatgtcccccacgcccggcccagggctggccacagagtaggtg

SEQ ID NO: 4435 - DNA, 168 bp, Artificial Sequence; identical to SEQ ID NO: 2538
  Synthetic polypeptide

SEQ ID NO: 4436 - DNA, 825 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgggg

SEQ ID NO: 4437 - DNA, 762 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttgtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgggg

SEQ ID NO: 4438 - DNA, 1026 bp, Artificial Sequence
  Synthetic polypeptide
atggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgctgactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgctgtgtgatcttggacgagttactgaaccttgctgtgtttcttcatcaatgaagtggaatcatcatggactccatctcatcagattgttttgaagagtaagtgagataatggacacacagtgcccagcacagagcctgacctagagtatgccct

SEQ ID NO: 4439 - DNA, 238 bp, Artificial Sequence
  Synthetic polypeptide
atgggactagctggcgtgtgcgccctgagacgctcagcgggctatatactcgtcggtggggccggcggtcagtctgcggcagcggcagcaagacggtacagtgaaggagagtgggcgtctggcggggtccgcagtttcagcagagccgctgcagccatggccccaatcaaggtgggagatgccatcccagcagtggaggccctgggccagattacttcctccacccctccctatctca

SEQ ID NO: 4440 - DNA, 494 bp, Artificial Sequence; identical to SEQ ID NO: 1298
  Synthetic polypeptide

SEQ ID NO: 4441 - DNA, 1119 bp, Artificial Sequence; identical to SEQ ID NO: 2066
  Synthetic polypeptide

SEQ ID NO: 4442 - DNA, 2364 bp, Artificial Sequence; identical to SEQ ID NO: 2067
  Synthetic polypeptide

SEQ ID NO: 4443 - DNA, 2421 bp, Artificial Sequence; identical to SEQ ID NO: 2068
  Synthetic polypeptide

SEQ ID NO: 4444 - DNA, 1521 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcaggggtgggtgggtgggaggggg

SEQ ID NO: 4445 - DNA, 810 bp, Artificial Sequence
  Synthetic polypeptide
atggcgcagaacgtgtatggtccgggagtccggataggcaactggaatgaggatgtctacctggaggaggagctcatgaaagacttcttagagaagagagacaaggggaaacttctcatacagagaagtagaagactaaaacagaatctcttgagaccgatgcaactttccgtaactgaagatggctatattcattacggtgacaaagtgatgcttgtgaatcctgatgatcctgacacagaagctgatgtgtttctgcgtggggacctgagcctgtgtatgactccagatgaaattcagtcccatctgaaagacgaattagaggtaccctgtggcctgagcgcagttcaagccaagaccccaattggcagaaacacttttatcattttgagtgtacacagagatgccactggtcaagtccttagatatgggcaggacttttgcctggggataacaggaggatttgacaacaaaatgttgtatttgtcaagtgaccacaggaccctcctgaaatcgtctaagaggtcttggctccaggaagtgtacctaacagatgaggtctcccatgtgaactgctggcaggctgccttccctgacccccagttacgcctggaatatgaaggcttccccgtcccgtacccgctcttttcactttaaatattgaggtccccggaccctcttcgggaaaaagcatggaccaccgatttttcctgttggcctgtgttctttttggtggacgcatctttgaccttggcaaataaacctcttaaaataattgagactcgcctcaataattttctttgatttata

SEQ ID NO: 4446 - DNA, 5629 bp, Artificial Sequence
  Synthetic polypeptide
atggcggacggggcaccccggccccagctttaccgcagcgtctcgttcaagctgctggagcgctggagcggcggccccgggctgagggaggaggacacggacacccccggcttgaggcgacgcgcctcgtgccggccgaccacggctgcccggggccagccctctcggcgcgtgtccaagctggcgtctgggcccctggccgcccccgcgcagccgcgcccgctccgcagcctctcgccgtcggttcgccagctctcccggcgcttcgacgcgccgcgtctggacgacggctccgctgggacccgagacggaggcgtcttacccgcggccgcggaagaagcggccgagggcccagcgcgaggagcctggcccagcgtcaccgagatgcgcaagctcttcggcggtcctggctccaggaggcccagcgccgactctgaatccccaggaacgcccagccccgacggtgccgcgtgggagcctccggctcgggagtcgcggcagccaccgacgccaccccctcggacatgcttccccctggcgggtctgcgttcggcgcggcccctgaccgggccggagaccgaagggaggctgcgccggccgcagcagcaacaggagcgggcgcagcgtccagcggatggtttacattcttggcatatcttctcccaaccgcaggccggggcccgggcctcctgctcctcctcctccatcgccgcctcctatcctgtcagccgcagtcgtgctgccagctccagcgaggaggaagaggagggcccgccgcagctgcctggagcccagagtccggcctaccacggcggccactcctcgggcagtgacgacgaccgagacggtgagggcggccaccgctggggagggaggcccgggctcaggcctggaagctccctattggatcaggactgcaggcctgacagtgatgggttaaatctaagcagcatgaactcagcaggggtttctgggagccctgagcccccaacatctccaagagcccctagagaagaaggactccgggagtggggtagtggctctccgccctgcgtcccaggtccccaggagggacttcggcctatgtctgactctgtgggaggagctttccgtgtggccaaggtgagctttccctcgtacctggccagccccgcaggctcccgcggtagcagccgttattccagcacggagaccctcaaggacgacgacctatggtctagtaggggttctgggggctggggcgtgtaccgctcccctagctttggagctggggaagggctcctgcggtcccaggctcgaacccgtgccaaaggacctggaggcacctctagggcattgagggatggaggatttgagcctgaaaagagtcgacagcggaagtccctgtcaaatccagatatcgcctcagagaccctgacgcttctcagtttcctgcgctcagacctttcagagctgagggtccgaaaacctggtgggagctccggggaccgtggaagcaaccccctagatggcagagactcaccatccgcaggtggccctgtggggcaacttgaacccatacccatcccagccccagcatcacctggcacgcgccccacactcaaggacttgacagccactctgcggagagcaaagtcattcacctgctctgagaagcccatggcccgccgcctgccccgcaccagtgctctgaagtccagctcctccgagctcctgctcacaggccctggtgccgaggaggatccgctgcccctcatcgtccaggaccaatatgtgcaggaggcccgccaggtttttgagaagatccagcgcatgggtgcccaacaagatgatggaagcgatgccccccctggaagccctgactgggcaggggatgtgacccgagggcagcggtcccaggaggagctctcaggccctgagtccagtctgacagatgaaggcattggggcagaccctgagcctcctgttgcagcattttgcggcctgggtaccacagggatgtggcgacctctttcctcatcctcggcccagacgaaccaccatggccctgggactgaggacagtctgggcgggtgggccctggtgtcgcctgagacccctcccacaccaggtgccctccgccgacgacgcaaagtcccaccttcaggttctggtgggagcgaattgagcaatggggaggcaggggaggcctacaggtccctgagtgacccaattcctcagcgccaccgggctgccacctctgaagagcctactgggttctctgtggacagcaacctcctgggctcactgagccccaagacagggctccctgccacctcagccatggatgagggcttgaccagtggtcacagtgactggtctgtgggcagtgaagagagcaagggatatcaggaggttattcagagcatagttcaggggcctggcaccctggggcgtgtggtggacgacaggattgctggcaaagcccccaagaagaaatccctgagtgaccccagccgccgtggggagctggctgggcctggattcgagggccctggaggggagcccatccgagaagttgagcccatgctgcctccatccagcagcgagcccatccttgtagagcagcgggcagagccagaagaacctggtgccaccaggagccgggcacagtctgaaagggccctacctgaggctctgcctccccctgccactgcccaccgaaactttcaccttgaccccaagctggctgacattctgtccccgaggctaatccgccgaggctccaagaagcgcccagctcggagtagtcaccaggagcttcggagagacgagggcagtcaggaccagactggcagcctgtctcgggcccggccctcctccagacacgttcgccatgccagtgtgcccgccacatttatgcctattgtggtgcctgagccaccaacttctgttggtccccctgtggctgtgccagaacccataggcttccctacccgagcccatcccacgttgcaggcaccatcgctcgaggacgtcaccaagcagtacatgctgaacctgcactccggtgaggtccctgccccagtgccagtggacatgccctgcttgcctctggctgcaccgccctctgctgaggccaagccccctgaggcagctcggcctgcagatgagcctacccctgccagcaagtgctgcagcaagccacaggtggacatgcggaagcacgtggccatgaccctgctggacacagagcagtcgtatgtggagtcgctgcgcaccctgatgcagggctacatgcagccgctgaagcagccagagaactccgtgctctgtgacccttcactggtggacgagatcttcgaccagatccccgagctcctggagcaccacgagcaattcctggagcaggttcggcactgcatgcagacctggcatgcccagcagaaggtgggagccctgctcgtccagtcgttctccaaggatgtcctagtaaacatctattctgcctatatcgataacttcctcaatgcaaaggatgctgtgcgtgtggccaaggaggcgaggcctgcctttctcaagttcctagagcaaagcatgcgtgagaacaaggagaagcaggcgctgtctgacctcatgatcaagcctgtgcagcggatcccacgctacgagcttctggtgaaggacctcctgaagcatacacctgaggaccacccggaccatccactcctgctggaggcgcagcggaacatcaagcaggtggctgagcgcatcaacaagggtgtgcggagtgccgaggaggcggagcgccatgcccgtgtgctgcaggagatagaggctcacatcgagggcatggaggatctccaggcccctctgcggcggttcctgagacaggagatggtcattgaagtgaaggcgatcggtggcaagaaggaccggtctctcttcctgttcacggacctcatcgtctgcaccactctgaagcgaaagtcaggctccctgcggcgcagctccatgagcctgtacacggcagccagtgtcattgacacagccagcaagtacaagatgctgtggaagctgccgctggaagacgcagacatcatcaaaggggcatcccaagccaccaatcgggagaacatccagaaggccatcagccgccttgatgaggacctcaccaccctgggccaaatgagcaagctctctgagagccttggtttcccccaccagagcctggacgatgcactgcgggacctctcagctgccatgcaccgggacctgtcggagaagcaggcgctgtgctacgcgctttccttcccgccaaccaagctggagctgtgcgccactcggcccgagggcaccgactcctacatttttgagttccctcaccctgacgcccgccttggttttgaacaggccttcgatgaggccaagaggaagctggcatccagcaaaagctgtctagaccctgagttcctgaaggccatccccatcatgaaaacccgcagtggcatgcagttctcctgtgcggctcccaccctgaacagctgcccggagccctcgcctgaggtatgggtctgcaacagcgacggctacgtgggccaggtgtgcctgctgagcctgcgcgccgagccggacgtggaggcctgcatcgccgtctgttccgcccgcatcctctgcatcggggcggtgcccgggctgcagcctcgctgccaccgggagcctcctccgtcgctgaggagtcctccagagacggcaccggagcccgccgggccggagctggacgtcgaggccgctgcagacgaggaagccgcgacgctcgcggagccggggccgcagccctgccttcacatctccattgcaggctcgggcttggagatgacgccgggcctcggcgagggtgacccccgcccagagctggtgccctttgacagtgactctgacgatgagtcttcgcccagcccctcggggacgctgcagagccaggccagccggtccaccatctcctccagctttggcaatgaggagaccccgagttccaaggaggccacggcagagaccaccagctcagaggaggagcaggagccaggcttcctgccactgtctggctcctttgggcctggtggtccctgcggcaccagcccaatggatgggagagcccttcgccgctccagccacggctccttcacccggggcagccttgaggacctgctgagtgtcgaccctgaggcctaccagagctccgtgtggctgggcactgaggatggctgtgtccacgtgtaccagtcctccgacagcatccgtgaccgcaggaacagcatgaagctccagcatgcggcctctgtgacctgcatcttgtatctgaataaccaggtgtttgtgtctctggccaatggagagcttgtggtctaccaaagggaagcaggccatttctgggacccccagaacttcaaatcagtgaccttgggcacccaggggagccccatcaccaagatggtatctgtgggtgggcggctgtggtgtggctgccagaaccgagtccttgtcctgagccctgacacgctgcagctggaggcttcagcttccccacctgtccagggggaggccagtgactgattttagaaccctttaagcattgaagttctctgatcct

SEQ ID NO: 4447 - DNA, 3628 bp, Artificial Sequence; identical to SEQ ID NO: 330
  Synthetic polypeptide

SEQ ID NO: 4448 - DNA, 3127 bp, Artificial Sequence; identical to SEQ ID NO: 332
  Synthetic polypeptide

SEQ ID NO: 4449 - DNA, 2713 bp, Artificial Sequence; identical to SEQ ID NO: 1273
  Synthetic polypeptide

SEQ ID NO: 4450 - DNA, 228 bp, Artificial Sequence; identical to SEQ ID NO: 1274
  Synthetic polypeptide

SEQ ID NO: 4451 - DNA, 383 bp, Artificial Sequence
  Synthetic polypeptide
atggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagaatctcttgaactccggagggggaggttgcagtgagccaagatcgcaccattgcactccagcctgggtaacaagagggaaacttcgtctcaaaaaggaaaa

SEQ ID NO: 4452 - DNA, 248 bp, Artificial Sequence
  Synthetic polypeptide
atggcgcagtctattaacatcacggagctgaatctgccgcagctagaaatgctcaagaaccagctggaccagatgtatgtccctgggaagctgcatgatgtggaacacgtgctcatcgatgtgggaactgggtactatgtagagaagaatctcttgaactccggagggggaggttgcagtgagccaagatcgcaccattgcactccagcctgggtaacaagagggaaacttcgtctcaaaaaggaaaa

SEQ ID NO: 4453 - DNA, 375 bp, Artificial Sequence
  Synthetic polypeptide
taacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggacggaatttcgctctgtcgcccaggctggagcgcaatgatgtatgtccctgggaagctgcatgatgtggaacacgtgctcatcgatgtgggaactgggtactatgtagagaagaatctcttgaactccggagggggaggttgcagtgagccaagatcgcaccattgcactccagcctgggtaacaagagggaaacttcgtctcaaaaaggaaaa

SEQ ID NO: 4454 - DNA, 147 bp, Artificial Sequence
  Synthetic polypeptide
atgatgcctgggcagatcccggacccttcggtgaccacaggctccctgccagggcttggccccctgaccgggctccccagctcggccctgactgtggaggaggaggaagaggagaaggaaaagtgacgaagagagaggaggaggggg

SEQ ID NO: 4455 - DNA, 180 bp, Artificial Sequence
  Synthetic polypeptide
atggtagcaggctggcctgccactcctcctgctatgatgcctgggcagatcccggacccttcggtgaccacaggctccctgccagggcttggccccctgaccgggctccccagctcggccctgactgtggaggaggaggaagaggagaaggaaaagtgacgaagagagaggaggaggggg

SEQ ID NO: 4456 - DNA, 1156 bp, Artificial Sequence; identical to SEQ ID NO: 1222
  Synthetic polypeptide

SEQ ID NO: 4457 - DNA, 919 bp, Artificial Sequence; identical to SEQ ID NO: 1223
  Synthetic polypeptide

SEQ ID NO: 4458 - DNA, 941 bp, Artificial Sequence; identical to SEQ ID NO: 1224
  Synthetic polypeptide

SEQ ID NO: 4459 - DNA, 689 bp, Artificial Sequence
  Synthetic polypeptide
atggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaaga

SEQ ID NO: 4460 - DNA, 803 bp, Artificial Sequence; identical to SEQ ID NO: 152
  Synthetic polypeptide

SEQ ID NO: 4461 - DNA, 1257 bp, Artificial Sequence
  Synthetic polypeptide
atgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggttcattgcaataggtgattcacattctccaaacctgctttgtctaatatgtgatgaccagctatccagaaaagccatgaaacctttaaaagtgcttcaccacatggagaccaaacaccctgcattaaaagacaagcctttggagtttttcaaaagaaaaaatcgtgaacgcaaagaacagaagtaattattgaaggccaccacttcatcaaatgtgtctgcagtgagagcatcattcttagtggctaatcacattgctaaagctaagaaggcctttactactggtgaagagttgatcctgcctgctgctaaggacatctgttgtgaactcttaggagagcctgcagttcaaaaggtggcacatgttcctcttctggctagcaccatagctagatgaattaatagaggatatgaggcacagttgttagaattaatgagtcactgtggtacccaatccaggttaatgagtctaccagtgttgacagcaaggcaacaatgcttgtttttgtgtgatacatttttcaggaggatgtgcatgaggatatattatgtgcacttttgctttcaaccaacaccacagctgcagaactattcaagtctttaaatacatatcaggaaaactgaattggtcattttgtatcgatatatgcagggatggagcagctgccatgactggacggctttctgttttcactactcaggtcaaagagcttgcttctgaatgtgagtctgtgtactgtgtcatctgtagagatgctggctagttggaaaatgccacctgaacttaccattttgtaggatgtgcttaaaattttcaaccacattaaagtacatgcccttaattcacatctgttcatgtagctctgtgagaagatagacacagagcacacgtcttctcttatacacagaagagagacggcttcctaaaggtagatcactggccactgtttttcagttacaatagctgctccagagatttcattttagaaaaagtcaccactggcagcacatttcgttgacacagaattgggtcacaaaattgcttactt

SEQ ID NO: 4462 - DNA, 1173 bp, Artificial Sequence
  Synthetic polypeptide
atgagtgctgccagagagtctcacccgcatggggtgaagcgttcagcctccccagacgacgataaagaacatactggtcgtcttgttataggagatcacaaatcaacatctcacttccgaaccggttcattgcaataggtgattcacattctccaaacctgctttgtctaatatgtgatgaccagctatccagaaaagccatgaaacctttaaaagtgcttcaccacatggagaccaaacaccctgcattaaaagacaagcctttggagtttttcaaaagaaaaaatcgtgaacgcaaagaacagaagtaattattgaaggccaccacttcatcaaatgtgtctgcagtgagagcatcattcttagtggctaatcacattgctaaagctaagaaggcctttactactggtgaagagttgatcctgcctgctgctaaggacatctgttgtgaactcttaggagagcctgcagttcaaaaggtggcacatgttcctcttctggctagcaccatagctagatgaattaatagaggatatgaggcacagttgttagaattaatgagtcactgtggtacccaatccaggttaatgagtctaccagtgttgacagcaaggcaacaatgcttgtttttgtgtgatacatttttcaggaggatgtgcatgaggatatattatgtgcacttttgctttcaaccaacaccacagctgcagaactattcaagtctttaaatacatatcaggaaaactgaattggtcattttgtatcgatatatgcagggatggagcagctgccatgactggacggctttctgttttcactactcaggtcaaagagcttgcttctgaatgtgagtctgtgtactgtgtcatctgtagagatgctggctagttggaaaatgccacctgaacttaccattttgtaggatgtgcttaaaattttcaaccacattaaagtacatgcccttaattcacatctgttcatgtagctctgtgagaagatagacacagagcacacgtcttctcttatacacagaagagagacggcttcctaaaggtagatcactggccactgtttttcagttacaatagctgctccagagatttcattttagaaaaagtcaccactggcagcacatttcgttgacacagaattgggtcacaaaattgcttactt

SEQ ID NO: 4463 - DNA, 1125 bp, Artificial Sequence
  Synthetic polypeptide
atgggtgcaggaaagaaagaacatactggtcgtcttgttataggagatcacaaatcaacatctcacttccgaaccggttcattgcaataggtgattcacattctccaaacctgctttgtctaatatgtgatgaccagctatccagaaaagccatgaaacctttaaaagtgcttcaccacatggagaccaaacaccctgcattaaaagacaagcctttggagtttttcaaaagaaaaaatcgtgaacgcaaagaacagaagtaattattgaaggccaccacttcatcaaatgtgtctgcagtgagagcatcattcttagtggctaatcacattgctaaagctaagaaggcctttactactggtgaagagttgatcctgcctgctgctaaggacatctgttgtgaactcttaggagagcctgcagttcaaaaggtggcacatgttcctcttctggctagcaccatagctagatgaattaatagaggatatgaggcacagttgttagaattaatgagtcactgtggtacccaatccaggttaatgagtctaccagtgttgacagcaaggcaacaatgcttgtttttgtgtgatacatttttcaggaggatgtgcatgaggatatattatgtgcacttttgctttcaaccaacaccacagctgcagaactattcaagtctttaaatacatatcaggaaaactgaattggtcattttgtatcgatatatgcagggatggagcagctgccatgactggacggctttctgttttcactactcaggtcaaagagcttgcttctgaatgtgagtctgtgtactgtgtcatctgtagagatgctggctagttggaaaatgccacctgaacttaccattttgtaggatgtgcttaaaattttcaaccacattaaagtacatgcccttaattcacatctgttcatgtagctctgtgagaagatagacacagagcacacgtcttctcttatacacagaagagagacggcttcctaaaggtagatcactggccactgtttttcagttacaatagctgctccagagatttcattttagaaaaagtcaccactggcagcacatttcgttgacacagaattgggtcacaaaattgcttactt

SEQ ID NO: 4464 - DNA, 202 bp, Artificial Sequence
  Synthetic polypeptide
atgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggcgagtcc

SEQ ID NO: 4465 - DNA, 286 bp, Artificial Sequence
  Synthetic polypeptide
atgttccaggtcccggatagcgagggcggccgcgccggctccaggaaatggcaactgctgacaggaagtttggcatccacctcccccagcctcctgagtggacaggggccctgggcaccacttcagagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggcgagtcc

SEQ ID NO: 4466 - DNA, 154 bp, Artificial Sequence
  Synthetic polypeptide
atgaagcccccaggaggagaatcgagcaatctttttggaagtccagaagaagctactccttccagcaggcctaataggatggcatctaatatttttggaccaacagaagaacctcagaacatacccaagaggacaaatcccccagggcgagtcc

SEQ ID NO: 4467 - DNA, 166 bp, Artificial Sequence
  Synthetic polypeptide
atgatgagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggcgagtcc

SEQ ID NO: 4468 - DNA, 97 bp, Artificial Sequence
  Synthetic polypeptide
ccttccagcaggcctaataggatggcatctaatatttttggaccaacagaagaacctcagaacatacccaagaggacaaatcccccagggcgagtcc

SEQ ID NO: 4469 - DNA, 6504 bp, Artificial Sequence
  Synthetic polypeptide
atggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaaccattatgttatgaggatgctttagcagcccagccctatggagcagccaatagctaccaccagcttaccagccctgtgcctgaggcatcttagaagtggatcctttagcccaagttaaacattcagatgaccggagccccagccaacatctcgactgaaacttcataagcaaccctgagccagaactatccagctaagccactcctgatttcttgacccacaaaaactatgagataataaatgtttattgttggtttaaaccactccgttttgaataatttgttatccgtcaatagataactaata

SEQ ID NO: 4470 - DNA, 6702 bp, Artificial Sequence
  Synthetic polypeptide
atggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccaggtgcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaaccattatgttatgaggatgctttagcagcccagccctatggagcagccaatagctaccaccagcttaccagccctgtgcctgaggcatcttagaagtggatcctttagcccaagttaaacattcagatgaccggagccccagccaacatctcgactgaaacttcataagcaaccctgagccagaactatccagctaagccactcctgatttcttgacccacaaaaactatgagataataaatgtttattgttggtttaaaccactccgttttgaataatttgttatccgtcaatagataactaata

SEQ ID NO: 4471 - DNA, 6696 bp, Artificial Sequence
  Synthetic polypeptide
atggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaaccattatgttatgaggatgctttagcagcccagccctatggagcagccaatagctaccaccagcttaccagccctgtgcctgaggcatcttagaagtggatcctttagcccaagttaaacattcagatgaccggagccccagccaacatctcgactgaaacttcataagcaaccctgagccagaactatccagctaagccactcctgatttcttgacccacaaaaactatgagataataaatgtttattgttggtttaaaccactccgttttgaataatttgttatccgtcaatagataactaata

SEQ ID NO: 4472 - DNA, 6804 bp, Artificial Sequence
  Synthetic polypeptide
atggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccaggtgcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaaccattatgttatgaggatgctttagcagcccagccctatggagcagccaatagctaccaccagcttaccagccctgtgcctgaggcatcttagaagtggatcctttagcccaagttaaacattcagatgaccggagccccagccaacatctcgactgaaacttcataagcaaccctgagccagaactatccagctaagccactcctgatttcttgacccacaaaaactatgagataataaatgtttattgttggtttaaaccactccgttttgaataatttgttatccgtcaatagataactaata

SEQ ID NO: 4473 - DNA, 489 bp, Artificial Sequence
  Synthetic polypeptide
atgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgagagccagggcagcttctcggggctggaaatattctctgtcttgatcttggagccggttttactggtatgttgagtt

SEQ ID NO: 4474 - DNA, 645 bp, Artificial Sequence
  Synthetic polypeptide
atgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgagagccagggcagcttctcggggctggaaatattctctgtcttgatcttggagccggttttactggtatgttgagtt

SEQ ID NO: 4475 - DNA, 726 bp, Artificial Sequence
  Synthetic polypeptide
cagatgatgaacttattgacgggcggacagaaactgtgtgctgattgtcacgttctgatttggctctgcggagttctttggccttctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgagagccagggcagcttctcggggctggaaatattctctgtcttgatcttggagccggttttactggtatgttgagtt

SEQ ID NO: 4476 - DNA, 739 bp, Artificial Sequence
  Synthetic polypeptide
ggtatgtgttgtaatggcggccgtttcattgtcaccggcgtcggcacggctgaatccgcgacgcatcgccgccatcccgtcttggccggcgccggggtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgagagccagggcagcttctcggggctggaaatattctctgtcttgatcttggagccggttttactggtatgttgagtt

SEQ ID NO: 4477 - DNA, 2163 bp, Artificial Sequence
  Synthetic polypeptide
atgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatcctgaacttcacagatgagctcacaccacccagattgataaactggcctatctcatcctgtggccccctcccaggaagtgactcagcacgagaggacagtatcaactccctatgatttcatctctcacctgaccaatcagaactcttgactcactggcccccctacccaccaaattatctttaaaaactccagtcctcaaattctcagagagactgatttgaataataacaaaactctggtgtactgcacagctggctctgcatgaattactctttattgcaatttctctgttttgataagtaagatctttcttgataaataagctctgtctaggcagtgggcaaggtgaacccgttaggtggttaca

SEQ ID NO: 4478 - DNA, 1767 bp, Artificial Sequence
  Synthetic polypeptide
atggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatcctgaacttcacagatgagctcacaccacccagattgataaactggcctatctcatcctgtggccccctcccaggaagtgactcagcacgagaggacagtatcaactccctatgatttcatctctcacctgaccaatcagaactcttgactcactggcccccctacccaccaaattatctttaaaaactccagtcctcaaattctcagagagactgatttgaataataacaaaactctggtgtactgcacagctggctctgcatgaattactctttattgcaatttctctgttttgataagtaagatctttcttgataaataagctctgtctaggcagtgggcaaggtgaacccgttaggtggttaca

SEQ ID NO: 4479 - DNA, 253 bp, Artificial Sequence
  Synthetic polypeptide
atggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgctgggtaagtggtagctct

SEQ ID NO: 4480 - DNA, 1052 bp, Artificial Sequence
  Synthetic polypeptide
atgagaggggtttcctgtctccaggtcctgctccttctggtgctgggagctgctgggactcagggaaggaagtctgcagcctgcgggcagccccgcatgtccagtcggatcgttgggggccgggatggccgggacggagagtggccgtggcaggcgagcatccagcatcgtggggcacacgtgtgcggggggtcgctcatcgccccccagtgggtgctgacagcggcgcactgcttccccaggagggcactgccagctgagtaccgcgtgcgcctgggggcgctgcgtctgggctccacctcgccccgcacgctctcggtgcccgtgcgacgggtgctgctgcccccggactactccgaggacggggcccgcggcgacctggcactgctgcagctgcgtcgcccggtgcccctgagcgctcgcgtccaacccgtctgcctgcccgtgcccggcgcccgcccgccgcccggcacaccatgccgggtcaccggctggggcagcctccgcccaggagtgcccctcccagagtggcgaccgctacaaggagtaagggtgccgctgctggactcgcgcacctgcgacggcctctaccacgtgggcgcggacgtgccccaggctgagcgcattgtgctgcctgggagtctgtgtgccggctacccccagggccacaaggacgcctgccagtcagattcacagcatgacagagatttgacaccagggagatcctccatagctggctttgaggacacggggaccacagccatgagcggcctctaagagctgagagacagccggcagggaatcggaaccctcagacccacagccgcaaggcactggattctggcagcaccctgaaggagctgggaagtaagttcttccccagcctccagataagagccccgccggccaatcccttcatttcaacctaaagagaccctaagcagagaacctagctgagccactcctgacctacaaagttgtgacttaataaatgtgtgctttaagctgctccatttgtgctgacttgttatacagcaataaaaactaatata

SEQ ID NO: 4481 - DNA, 1019 bp, Artificial Sequence
  Synthetic polypeptide
atgagaggggtttcctgtctccaggtcctgctccttctggtgctggcctgcgggcagccccgcatgtccagtcggatcgttgggggccgggatggccgggacggagagtggccgtggcaggcgagcatccagcatcgtggggcacacgtgtgcggggggtcgctcatcgccccccagtgggtgctgacagcggcgcactgcttccccaggagggcactgccagctgagtaccgcgtgcgcctgggggcgctgcgtctgggctccacctcgccccgcacgctctcggtgcccgtgcgacgggtgctgctgcccccggactactccgaggacggggcccgcggcgacctggcactgctgcagctgcgtcgcccggtgcccctgagcgctcgcgtccaacccgtctgcctgcccgtgcccggcgcccgcccgccgcccggcacaccatgccgggtcaccggctggggcagcctccgcccaggagtgcccctcccagagtggcgaccgctacaaggagtaagggtgccgctgctggactcgcgcacctgcgacggcctctaccacgtgggcgcggacgtgccccaggctgagcgcattgtgctgcctgggagtctgtgtgccggctacccccagggccacaaggacgcctgccagtcagattcacagcatgacagagatttgacaccagggagatcctccatagctggctttgaggacacggggaccacagccatgagcggcctctaagagctgagagacagccggcagggaatcggaaccctcagacccacagccgcaaggcactggattctggcagcaccctgaaggagctgggaagtaagttcttccccagcctccagataagagccccgccggccaatcccttcatttcaacctaaagagaccctaagcagagaacctagctgagccactcctgacctacaaagttgtgacttaataaatgtgtgctttaagctgctccatttgtgctgacttgttatacagcaataaaaactaatata

SEQ ID NO: 4482 - DNA, 413 bp, Artificial Sequence
  Synthetic polypeptide
atgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagaccagccccatccatcaagttaccccagagctcatcatgaatgcagattctcaggccccagccaggacctactgaattggaactgcatttcaacaagatcctc

SEQ ID NO: 4483 - DNA, 344 bp, Artificial Sequence
  Synthetic polypeptide
atgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctgactacctgtatgctgtgagggaccgtgaaatgtttggatatatgaaattacatccagaggattttcctgaagaagaccagccccatccatcaagttaccccagagctcatcatgaatgcagattctcaggccccagccaggacctactgaattggaactgcatttcaacaagatcctc

SEQ ID NO: 4484 - DNA, 1324 bp, Artificial Sequence; identical to SEQ ID NO: 326
  Synthetic polypeptide

SEQ ID NO: 4485 - DNA, 121 bp, Artificial Sequence
  Synthetic polypeptide
atgcatacgcaagactcggaggtagttccggttccggcgtggccattttcgttggtggtgttcagttgtggcggttgctggtcagtaacagccaagatgctgcggaatctgctggctctaa

SEQ ID NO: 4486 - DNA, 25 bp, Artificial Sequence
  Synthetic polypeptide
atgctgcggaatctgctggctctaa

SEQ ID NO: 4487 - DNA, 78 bp, Artificial Sequence
  Synthetic polypeptide
cattttcgttggtggtgttcagttgtggcggttgctggtcagtaacagccaagatgctgcggaatctgctggctctaa

SEQ ID NO: 4488 - DNA, 1497 bp, Artificial Sequence
  Synthetic polypeptide
atgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaaatggagtcccactctgttgcccaggctggagtacagtggcatgatcttggctcactgcaacctccacctcccagatgtcaagcgattctcttgcctcagcctcccaagtagctggggttacaggcatgtgccaccatgtgcctttcacctcctgccatgattctgaggcctccccagccatgtggaactgtaagtccaattaaacctctttttcttcccagtctctggtatgtctttatcagcagcatgaaaacaaactaataca

SEQ ID NO: 4489 - DNA, 1331 bp, Artificial Sequence
  Synthetic polypeptide
atggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaa

SEQ ID NO: 4490 - DNA, 1382 bp, Artificial Sequence
  Synthetic polypeptide
atggggtacttccggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaa

SEQ ID NO: 4491 - DNA, 1271 bp, Artificial Sequence
  Synthetic polypeptide
atggggtacttccggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaa

SEQ ID NO: 4492 - DNA, 1031 bp, Artificial Sequence
  Synthetic polypeptide
atggagcgggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacagcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4493 - DNA, 962 bp, Artificial Sequence
  Synthetic polypeptide
atggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacagcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4494 - DNA, 758 bp, Artificial Sequence
  Synthetic polypeptide
atggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacagcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacaaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4495 - DNA, 374 bp, Artificial Sequence
  Synthetic polypeptide
tttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4496 - DNA, 500 bp, Artificial Sequence
  Synthetic polypeptide
ctgatcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacaaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4497 - DNA, 509 bp, Artificial Sequence
  Synthetic polypeptide
atggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4498 - DNA, 827 bp, Artificial Sequence
  Synthetic polypeptide
atggagcgggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacagcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacaaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4499 - DNA, 526 bp, Artificial Sequence
  Synthetic polypeptide
tggggaaacagtctgtgaacagaggattcactaaggacaagactctcagttcaatctttaacattgagatggtaaaagaaaaaactgcagaagaaataaaacaggcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4500 - DNA, 698 bp, Artificial Sequence
  Synthetic polypeptide
atgtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacggactgtgagctccttgagggccaggacttatctctgttcgcagtgccaaggacatggcctggaccatagaagatactcagttttttgttgaataaat

SEQ ID NO: 4501 - DNA, 632 bp, Artificial Sequence
  Synthetic polypeptide
atgacacagctgcttctgttccttgtggctctcctggttctgggtcatgtgccatcagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgccccgccgccatcccgtctaggaagtgaggagcgcctcttcccggcagccatcccatctgggaagtgaggagcgtctctgcccggccgcccatcgtctgagatgtggggagcgcctctgccccgccgccccgtctgggatgtgaggagcgcctctgccaggctgcgaccccgtctgggaggtgaggagcgtctctgcccagccgccccgtctgagaagtgaggagcccctccgcccggcagctgccccgtctgagaagtgaggagcccctctgcccggcagccaccccgtctgggaagtgaggagcgtctccgcccggcagccgccccgtccgggagggaggtggggggatcagcctcctgcccggccagccgccccgtccgggagggaggtgggggggtcagccccccgtccgg

SEQ ID NO: 4502 - DNA, 584 bp, Artificial Sequence
  Synthetic polypeptide
atggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgctgtgaggtatgccttatttgcagttggatgctcagccaccagcccagtgtcttgcacaaagtaggaacttattaaatgtttgttgaataaa

SEQ ID NO: 4503 - DNA, 623 bp, Artificial Sequence
  Synthetic polypeptide
atggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaaggtttgactcctgtttaaagtatggccatcataaaaggggaatcttgtggaagaagaatgaagttgctgattatgaagctacaacattttccatcttctataacaacactctgttcctggtcgtggtcattgttgcttccttcttcatattgaagaacttcaaccccacagtgctgtgaggtatgccttatttgcagttggatgctcagccaccagcccagtgtcttgcacaaagtaggaacttattaaatgtttgttgaataaa

SEQ ID NO: 4504 - DNA, 428 bp, Artificial Sequence
  Synthetic polypeptide
atggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgctgtgaggtatgccttatttgcagttggatgctcagccaccagcccagtgtcttgcacaaagtaggaacttattaaatgtttgttgaataaa

SEQ ID NO: 4505 - DNA, 32605 bp, Artificial Sequence
  Synthetic polypeptide
atgctgaaaccctcaggccttcctgggtcatcttctcccacccgctccttgatgacagggagcaggagcactaaagccacaccagaaatggattcaggactgacaggagccaccttgtcacctaagacatctacaggtgcaatcgtggtgacagaacatactctgccctttacttccccagataagaccttggccagtcctacatcttcggttgtgggaagaaccacccagtctttgggggtgatgtcctctgctctccctgagtcaacctctagaggaatgacacactccgagcaaagaaccagcccatcgctgagtccccaggtcaatggaactccctctaggaactaccctgctacaagcatggtttcaggattgagttccccaaggaccaggaccagttccacagaaggaaattttaccaaagaagcatctacatacacactcactgtagagaccacaagtggcccagtcactgagaagtacacagtccccactgagacctcaacaactgaaggtgacagcacagagaccccctgggacacaagatatattcctgtaaaaatcacatctccaatgaaaacatttgcagattcaactgcatccaaggaaaatgccccagtgtctatgactccagctgagaccacagttactgactcacatactccaggaaggacaaacccatcatttgggacactttattcttccttccttgacctatcacctaaagggaccccaaattccagaggtgaaacaagcctggaactgattctatcaaccactggatatcccttctcctctcctgaacctggctctgcaggacacagcagaataagtaccagtgcgcctttgtcatcatctgcttcagttctcgataataaaatatcagagaccagcatattctcaggccagagtctcacctcccctctgtctcctggggtgcccgaggccagagccagcacaatgcccaactcagctatccctttttccatgacactaagcaatgcagaaacaagtgccgaaagggtcagaagcacaatttcctctctggggactccatcaatatccacaaagcagacagcagagactatccttaccttccatgccttcgctgagaccatggatatacccagcacccacatagccaagactttggcttcagaatggttgggaagtccaggtacccttggtggcaccagcacttcagcgctgacaaccacatctccatctaccactttagtctcagaggagaccaacacccatcactccacgagtggaaaggaaacagaaggaactttgaatacatctatgactccacttgagacctctgctcctggagaagagtccgaaatgactgccaccttggtccccactctaggttttacaactcttgacagcaagatcagaagtccatctcaggtctcttcatcccacccaacaagagagctcagaaccacaggcagcacctctgggaggcagagttccagcacagctgcccacgggagctctgacatcctgagggcaaccacttccagcacctcaaaagcatcatcatggaccagtgaaagcacagctcagcaatttagtgaaccccagcacacacagtgggtggagacaagtcctagcatgaaaacagagagacccccagcatcaaccagtgtggcagcccctatcaccacttctgttccctcagtggtctctggcttcaccaccctgaagaccagctccacaaaagggatttggcttgaagaaacatctgcagacacactcatcggagaatccacagctggcccaaccacccatcagtttgctgttcccactgggatttcaatgacaggaggcagcagcaccaggggaagccagggcacaacccacctactcaccagagccacagcatcatctgagacatccgcagatttgactctggccacgaacggtgtcccagtctccgtgtctccagcagtgagcaagacggctgctggctcaagtcctccaggagggacaaagccatcatatacaatggtttcttctgtcatccctgagacatcatctctacagtcctcagctttcagggaaggaaccagcctgggactgactccattaaacactagacatcccttctcttcccctgaaccagactctgcaggacacaccaagataagcaccagcattcctctgttgtcatctgcttcagttcttgaggataaagtgtcagcgaccagcacattctcacaccacaaagccacctcatctattaccacagggactcctgaaatctcaacaaagacaaagcccagctcagccgttctttcctccatgaccctaagcaatgcagcaacaagtcctgaaagagtcagaaatgcaacttcccctctgactcatccatctccatcaggggaagagacagcagggagtgtcctcactctcagcacctctgctgagactacagactcacctaacatccacccaactgggacactgacttcagaatcgtcagagagtcctagcactctcagcctcccaagtgtctctggagtcaaaaccacattttcttcatctactccttccactcatctatttactagtggagaagaaacagaggaaacttcgaatccatctgtgtctcaacctgagacttctgtttccagagtaaggaccaccttggccagcacctctgtccctaccccagtattccccaccatggacacctggcctacacgttcagctcagttctcttcatcccacctagtgagtgagctcagagctacgagcagtacctcagttacaaactcaactggttcagctcttcctaaaatatctcacctcactgggacggcaacaatgtcacagaccaatagagacacgtttaatgactctgctgcaccccaaagcacaacttggccagagactagtcccagattcaagacagggttaccttcagcaacaaccactgtttcaacctctgccacttctctctctgctactgtaatggtctctaaattcacttctccagcaactagttccatggaagcaacttctatcagggaaccatcaacaaccatcctcacaacagagaccacgaatggcccaggctctatggctgtggcttctaccaacatcccaattggaaagggctacattactgaaggaagattggacacaagccatctgcccattggaaccacagcttcctctgagacatctatggattttaccatggccaaagaaagtgtctcaatgtcagtatctccatctcagtccatggatgctgctggctcaagcactccaggaaggacaagccaattcgttgacacattttctgatgatgtctatcatttaacatccagagaaattacaatacctagagatggaacaagctcagctctgactccacaaatgactgcaactcaccctccatctcctgatcctggctctgctagaagcacctggcttggcatcttgtcctcatctccttcttctcctactcccaaagtcacaatgagctccacattttcaactcagagagtcaccacaagcatgataatggacacagttgaaactagtcggtggaacatgcccaacttaccttccacgacttccttgacaccaagtaatattccaacaagtggtgccataggaaaaagcaccctggttcccttggacactccatctccagccacatcattggaggcatcagaagggggacttccaaccctcagcacctaccctgaatcaacaaacacacccagcatccacctcggagcacacgctagttcagaaagtccaagcaccatcaaacttaccatggcttcagtagtaaaacctggctcttacacacctctcaccttcccctcaatagagacccacattcatgtatcaacagccagaatggcttactcttctgggtcttcacctgagatgacagctcctggagagactaacactggtagtacctgggaccccaccacctacatcaccactacggatcctaaggatacaagttcagctcaggtctctacaccccactcagtgaggacactcagaaccacagaaaaccatccaaagacagagtccgccaccccagctgcttactctggaagtcctaaaatctcaagttcacccaatctcaccagtccggccacaaaagcatggaccatcacagacacaactgaacactccactcaattacattacacaaaattggcagaaaaatcatctggatttgagacacagtcagctccaggacctgtctctgtagtaatccctacctcccctaccattggaagcagcacattggaactaacttctgatgtcccaggggaacccctggtccttgctcccagtgagcagaccacaatcactctccccatggcaacatggctgagtaccagtttgacagaggaaatggcttcaacagaccttgatatttcaagtccaagttcacccatgagtacatttgctatttttccacctatgtccacaccttctcatgaactttcaaagtcagaggcagataccagtgccattagaaatacagattcaacaacgttggatcagcacctaggaatcaggagtttgggcagaactggggacttaacaactgttcctatcaccccactgacaaccacgtggaccagtgtgattgaacactcaacacaagcacaggacaccctttctgcaacgatgagtcctactcacgtgacacagtcactcaaagatcaaacatctataccagcctcagcatccccttcccatcttactgaagtctaccctgagctcgggacacaagggagaagctcctctgaggcaaccactttttggaaaccatctacagacacactgtccagagagattgagactggcccaacaaacattcaatccactccacccatggacaacacaacaacagggagcagtagtagtggagtcaccctgggcatagcccaccttcccataggaacatcctccccagctgagacatccacaaacatggcactggaaagaagaagttctacagccactgtctctatggctgggacaatgggactccttgttactagtgctccaggaagaagcatcagccagtcattaggaagagtttcctctgtcctttctgagtcaactactgaaggagtcacagattctagtaagggaagcagcccaaggctgaacacacagggaaatacagctctctcctcctctcttgaacccagctatgctgaaggaagccagatgagcacaagcatccctctaacctcatctcctacaactcctgatgtggaattcatagggggcagcacattttggaccaaggaggtcaccacagttatgacctcagacatctccaagtcttcagcaaggacagagtccagctcagctacccttatgtccacagctttgggaagcactgaaaatacaggaaaagaaaaactcagaactgcctctatggatcttccatctccaactccatcaatggaggtgacaccatggatttctctcactctcagtaatgcccccaataccacagattcacttgacctcagccatggggtgcacaccagctctgcagggactttggccactgacaggtcattgaatactggtgtcactagagcctccagattggaaaacggctctgatacctcttctaagtccctgtctatgggaaacagcactcacacttccatgacttacacagagaagagtgaagtgtcttcttcaatccatccccgacctgagacctcagctcctggagcagagaccactttgacttccactcctggaaacagggccataagcttaacattgcctttttcatccattccagtggaagaagtcatttctacaggcataacctcaggaccagacatcaactcagcacccatgacacattctcccatcaccccaccaacaattgtatggaccagtacaggcacaattgaacagtccactcaaccactacatgcagtttcttcagaaaaagtttctgtgcagacacagtcaactccatatgtcaactctgtggcagtgtctgcttcccctacccatgagaattcagtctcttctggaagcagcacatcctctccatattcctcagcctcacttgaatccttggattccacaatcagtaggaggaatgcaatcacttcctggctatgggacctcactacatctctccccactacaacttggccaagtactagtttatctgaggcactgtcctcaggccattctggggtttcaaacccaagttcaactacgactgaatttccactcttttcagctgcatccacatctgctgctaagcaaagaaatccagaaacagagacccatggtccccagaatacagccgcgagtactttgaacactgatgcatcctcggtcacaggtctttctgagactcctgtgggggcaagtatcagctctgaagtccctcttccaatggccataacttctagatcagatgtttctggccttacatctgagagtactgctaacccgagtttaggcacagcctcttcagcagggaccaaattaactaggacaatatccctgcccacttcagagtctttggtttcctttagaatgaacaaggatccatggacagtgtcaatccctttggggtcccatccaactactaatacagaaacaagcatcccagtaaacagcgcaggtccacctggcttgtccacagtagcatcagatgtaattgacacaccttcagatggggctgagagtattcccactgtctccttttccccctcccctgatactgaagtgacaactatctcacatttcccagaaaagacaactcattcatttagaaccatttcatctctcactcatgagttgacttcaagagtgacacctattcctggggattggatgagttcagctatgtctacaaagcccacaggagccagtccctccattacactgggagagagaaggacaatcacctctgctgctccaaccacttcccccatagttctcactgctagtttcacagagaccagcacagtttcactggataatgaaactacagtaaaaacctcagatatccttgacgcacggaaaacaaatgagctcccctcagatagcagttcttcttctgatctgatcaacacctccatagcttcttcaactatggatgtcactaaaacagcctccatcagtcccactagcatctcaggaatgacagcaagttcctccccatctctcttctcttcagatagaccccaggttcccacatctacaacagagacaaatacagccacctctccatctgtttccagtaacacctattctcttgatgggggctccaatgtgggtggcactccatccactttaccaccctttacaatcacccaccctgtcgagacaagctcggccctattagcctggtctagaccagtaagaactttcagcaccatggtcagcactgacactgcctccggagaaaatcctacctctagcaattctgtggtgacttctgttccagcaccaggtacatggaccagtgtaggcagtactactgacttacctgccatgggctttctcaagacaagtcctgcaggagaggcacactcacttctagcatcaactattgaaccagccactgccttcactccccatctctcagcagcagtggtcactggatccagtgctacatcagaagccagtcttctcactacgagtgaaagcaaagccattcattcttcaccacagaccccaactacacccacctctggagcaaactgggaaacttcagctactcctgagagccttttggtagtcactgagacttcagacacaacacttacctcaaagattttggtcacagataccatcttgttttcaactgtgtccacgccaccttctaaatttccaagtacggggactctgtctggagcttccttccctactttactcccggacactccagccatccctctcactgccactgagccaacaagttcattagctacatcctttgattccaccccactggtgactatagcttcggatagtcttggcacagtcccagagactaccctgaccatgtcagagacctcaaatggtgatgcactggttcttaagacagtaagtaacccagataggagcatccctggaatcactatccaaggagtaacagaaagtccactccatccttcttccacttccccctctaagattgttgctccacggaatacaacctatgaaggttcgatcacagtggcactttctactttgcctgcgggaactactggttcccttgtattcagtcagagttctgaaaactcagagacaacggctttggtagactcatcagctgggcttgagagggcatctgtgatgccactaaccacaggaagccagggtatggctagctctggaggaatcagaagtgggtccactcactcaactggaaccaaaacattttcttctctccctctgaccatgaacccaggtgaggttacagccatgtctgaaatcaccacgaacagactgacagctactcaatcaacagcacccaaagggatacctgtgaagcccaccagtgctgagtcaggcctcctaacacctgtctctgcctcctcaagcccatcaaaggcctttgcctcactgactacagctcccccaacttgggggatcccacagtctaccttgacatttgagttttctgaggtcccaagtttggatactaagtccgcttctttaccaactcctggacagtccctgaacaccattccagactcagatgcaagcacagcatcttcctcactgtccaagtctccagaaaaaaacccaagggcaaggatgatgacttccacaaaggccataagtgcaagctcatttcaatcaacaggttttactgaaacccctgagggatctgcctccccttctatggcagggcatgaacccagagtccccacttcaggaacaggggaccctagatatgcctcagagagcatgtcttatccagacccaagcaaggcatcatcagctatgacatcgacctctcttgcatcaaaactcacaactctcttcagcacaggtcaagcagcaaggtctggttctagttcctctcccataagcctatccactgagaaagaaacaagcttcctttcccccactgcatccacctccagaaagacttcactatttcttgggccttccatggcaaggcagcccaacatattggtgcatcttcagacttcagctctgacactttctccaacatccactctaaatatgtcccaggaggagcctcctgagttaacctcaagccagaccattgcagaagaagagggaacaacagctgaaacacagacgttaaccttcacaccatctgagaccccaacatccttgttacctgtctcttctcccacagaacccacagccagaagaaagagttctccagaaacatgggcaagctctatttcagttcctgccaagacctccttggttgaaacaactgatggaacgctagtgaccaccataaagatgtcaagccaggcagcacaaggaaattccacgtggcctgccccagcagaggagacggggagcagtccagcaggcacatccccaggaagcccagaaatgtctaccactctcaaaatcatgagctccaaggaacccagcatcagcccagagatcaggtccactgtgagaaattctccttggaagactccagaaacaactgttcccatggagaccacagtggaaccagtcacccttcagtccacagccctaggaagtggcagcaccagcatctctcacctgcccacaggaaccacatcaccaaccaagtcaccaacagaaaatatgttggctacagaaagggtctccctctccccatccccacctgaggcttggaccaacctttattctggaactccaggagggaccaggcagtcactggccacaatgtcctctgtctccctagagtcaccaactgctagaagcatcacagggactggtcagcaaagcagtccagaactggtttcaaagacaactggaatggaattctctatgtggcatggctctactggagggaccacaggggacacacatgtctctctgagcacatcttccaatatccttgaagaccctgtaaccagcccaaactctgtgagctcattgacagataaatccaaacataaaaccgagacatgggtaagcaccacagccattccctccactgtcctgaataataagataatggcagctgaacaacagacaagtcgatctgtggatgaggcttattcatcaactagttcttggtcagatcagacatctgggagtgacatcacccttggtgcatctcctgatgtcacaaacacattatacatcacctccacagcacaaaccacctcactagtgtctctgccctctggagaccaaggcattacaagcctcaccaatccctcaggaggaaaaacaagctctgcgtcatctgtcacatctccttcaatagggcttgagactctgagggccaatgtaagtgcagtgaaaagtgacattgcccctactgctgggcatctatctcagacttcatctcctgcggaagtgagcatcctggacgtaaccacagctcctactccaggtatctccaccaccatcaccaccatgggaaccaactcaatctcaactaccacacccaacccagaagtgggtatgagtaccatggacagcaccccggccacagagaggcgcacaacttctacagaacacccttccacctggtcttccacagctgcatcagattcctggactgtcacagacatgacttcaaacttgaaagttgcaagatctcctggaacaatttccacaatgcatacaacttcattcttagcctcaagcactgaattagactccatgtctactccccatggccgtataactgtcattggaaccagcctggtcactccatcctctgatgcttcagctgtaaagacagagaccagtacaagtgaaagaacattgagtccttcagacacaactgcatctactcccatctcaactttttctcgtgtccagaggatgagcatctcagttcctgacattttaagtacaagttggactcccagtagtacagaagcagaagatgtgcctgtttcaatggtttctacagatcatgctagtacaaagactgacccaaatacgcccctgtccacttttctgtttgattctctgtccactcttgactgggacactgggagatctctgtcatcagccacagccactacctcagctcctcagggggccacaactccccaggaactcactttggaaaccatgatcagcccagctacctcacagttgcccttctctatagggcacattacaagtgcagtcacaccagctgcaatggcaaggagctctggagttactttttcaagaccagatcccacaagcaaaaaggcagagcagacttccactcagcttcccaccaccacttctgcacatccagggcaggtgcccagatcagcagcaacaactctggatgtgatcccacacacagcaaaaactccagatgcaacttttcagagacaagggcagacagctcttacaacagaggcaagagctacatctgactcctggaatgagaaagaaaaatcaaccccaagtgcaccttggatcactgagatgatgaattctgtctcagaagataccatcaaggaggttaccagctcctccagtgtattaaggaccctgaatacgctggacataaacttggaatctgggacgacttcatccccaagttggaaaagcagcccatatgagagaattgccccttctgagtccaccacagacaaagaggcaattcacccttctacaaacacagtagagaccacaggctgggtcacaagttccgaacatgcttctcattccactatcccagcccactcagcgtcatccaaactcacatctccagtggttacaacctccaccagggaacaagcaatagtttctatgtcaacaaccacatggccagagtctacaagggctagaacagagcctaattccttcttgactattgaactgagggacgtcagcccttacatggacaccagctcaaccacacaaacaagtattatctcttccccaggttccactgcgatcaccaaggggcctagaacagaaattacctcctctaagagaatatccagctcattccttgcccagtctatgaggtcgtcagacagcccctcagaagccatcaccaggctgtctaactttcctgccatgacagaatctggaggaatgatccttgctatgcaaacaagtccacctggcgctacatcactaagtgcacctactttggatacatcagccacagcctcctggacagggactccactggctacgactcagagatttacatactcagagaagaccactctctttagcaaaggtcctgaggatacatcacagccaagccctccctctgtggaagaaaccagctcttcctcttccctggtacctatccatgctacaacctcgccttccaatattttgttgacatcacaagggcacagtccctcctctactccacctgtgacctcagttttcttgtctgagacctctggcctggggaagaccacagacatgtcgaggataagcttggaacctggcacaagtttacctcccaatttgagcagtacagcaggtgaggcgttatccacttatgaagcctccagagatacaaaggcaattcatcattctgcagacacagcagtgacgaatatggaggcaaccagttctgaatattctcctatcccaggccatacaaagccatccaaagccacatctccattggttacctcccacatcatgggggacatcacttcttccacatcagtatttggctcctccgagaccacagagattgagacagtgtcctctgtgaaccagggacttcaggagagaagcacatcccaggtggccagctctgctacagagacaagcactgtcattacccatgtgtctagtggtgatgctactactcatgtcaccaagacacaagccactttctctagcggaacatccatctcaagccctcatcagtttataacttctaccaacacatttacagatgtgagcaccaacccctccacctctctgataatgacagaatcttcaggagtgaccatcaccacccaaacaggtcctactggagctgcaacacagggtccatatctcttggacacatcaaccatgccttacttgacagagactccattagctgtgactccagattttatgcaatcagagaagaccactctcataagcaaaggtcccaaggatgtgtcctggacaagccctccctctgtggcagaaaccagctatccctcttccctgacacctttcttggtcacaaccatacctcctgccacttccacgttacaagggcaacatacatcctctcctgtttctgcgacttcagttcttacctctggactggtgaagaccacagatatgttgaacacaagcatggaacctgtgaccaattcacctcaaaatttgaacaatccatcaaatgagatactggccactttggcagccaccacagatatagagactattcatccttccataaacaaagcagtgaccaatatggggactgccagttcagcacatgtactgcattccactctcccagtcagctcagaaccatctacagccacatctccaatggttcctgcctccagcatgggggacgctcttgcttctatatcaatacctggttctgagaccacagacattgagggagagccaacatcctccctgactgctggacgaaaagagaacagcaccctccaggagatgaactcaactacagagtcaaacatcatcctctccaatgtgtctgtgggggctattactgaagccacaaaaatggaagtcccctcttttgatgcaacattcataccaactcctgctcagtcaacaaagttcccagatattttctcagtagccagcagtagactttcaaactctcctcccatgacaatatctacccacatgaccaccacccagacagggtcttctggagctacatcaaagattccacttgccttagacacatcaaccttggaaacctcagcagggactccatcagtggtgactgaggggtttgcccactcaaaaataaccactgcaatgaacaatgatgtcaaggacgtgtcacagacaaaccctccctttcaggatgaagccagctctccctcttctcaagcacctgtccttgtcacaaccttaccttcttctgttgctttcacaccgcaatggcacagtacctcctctcctgtttctatgtcctcagttcttacttcttcactggtaaagaccgcaggcaaggtggatacaagcttagaaacagtgaccagttcacctcaaagtatgagcaacactttggatgacatatcggtcacttcagcagccaccacagatatagagacaacgcatccttccataaacacagtagttaccaatgtggggaccaccggttcagcatttgaatcacattctactgtctcagcttacccagagccatctaaagtcacatctccaaatgttaccacctccaccatggaagacaccacaatttccagatcaatacctaaatcctctaagactacaagaactgagactgagacaacttcctccctgactcctaaactgagggagaccagcatctcccaggagatcacctcgtccacagagacaagcactgttccttacaaagagctcactggtgccactaccgaggtatccaggacagatgtcacttcctctagcagtacatccttccctggccctgatcagtccacagtgtcactagacatctccacagaaaccaacaccaggctgtctacctccccaataatgacagaatctgcagaaataaccatcaccacccaaacaggtcctcatggggctacatcacaggatacttttaccatggacccatcaaatacaaccccccaggcagggatccactcagctatgactcatggattttcacaattggatgtgaccactcttatgagcagaattccacaggatgtatcatggacaagtcctccctctgtggataaaaccagctccccctcttcctttctgtcctcacctgcaatgaccacaccttccctgatttcttctaccttaccagaggataagctctcctctcctatgacttcacttctcacctctggcctagtgaagattacagacatattacgtacacgcttggaacctgtgaccagctcacttccaaatttcagcagcacctcagataagatactggccacttctaaagacagtaaagacacaaaggaaatttttccttctataaacacagaagagaccaatgtgaaagccaacaactctggacatgaatcccattcccctgcactggctgactcagagacacccaaagccacaactcaaatggttatcaccaccactgtgggagatccagctccttccacatcaatgccagtgcatggttcctctgagactacaaacattaagagagagccaacatatttcttgactcctagactgagagagaccagtacctctcaggagtccagctttcccacggacacaagttttctactttccaaagtccccactggtactattactgaggtctccagtacaggggtcaactcttctagcaaaatttccaccccagaccatgataagtccacagtgccacctgacaccttcacaggagagatccccagggtcttcacctcctctattaagacaaaatctgcagaaatgacgatcaccacccaagcaagtcctcctgagtctgcatcgcacagtacccttcccttggacacatcaaccacactttcccagggagggactcattcaactgtgactcagggattcccatactcagaggtgaccactctcatgggcatgggtcctgggaatgtgtcatggatgacaactccccctgtggaagaaaccagctctgtgtcttccctgatgtcttcacctgccatgacatccccttctcctgtttcctccacatcaccacagagcatcccctcctctcctcttcctgtgactgcacttcctacttctgttctggtgacaaccacagatgtgttgggcacaacaagcccagagtctgtaaccagttcacctccaaatttgagcagcatcactcatgagagaccggccacttacaaagacactgcacacacagaagccgccatgcatcattccacaaacaccgcagtgaccaatgtagggacttccgggtctggacataaatcacaatcctctgtcctagctgactcagagacatcgaaagccacacctctgatgagtaccacctccaccctgggggacacaagtgtttccacatcaactcctaatatctctcagactaaccaaattcaaacagagccaacagcatccctgagccctagactgagggagagcagcacgtctgagaagaccagctcaacaacagagacaaatactgccttttcttatgtgcccacaggtgctattactcaggcctccagaacagaaatctcctctagcagaacatccatctcagaccttgatcggcccacaatagcacccgacatctccacaggaatgatcaccaggctcttcacctcccccatcatgacaaaatctgcagaaatgaccgtcaccactcaaacaactactcctggggctacatcacagggtatccttccctgggacacatcaaccacacttttccagggagggactcattcaaccgtgtctcagggattcccacactcagagataaccactcttcggagcagaacccctggagatgtgtcatggatgacaactccccctgtggaagaaaccagctctgggttttccctgatgtcaccttccatgacatccccttctcctgtttcctccacatcaccagagagcatcccctcctctcctctccctgtgactgcacttcttacttctgttctggtgacaaccacaaatgtattgggcacaacaagcccagagcccgtaacgagttcacctccaaatttaagcagccccacacaggagagactgaccacttacaaagacactgcgcacacagaagccatgcatgcttccatgcatacaaacactgcagtggccaacgtggggacctccatttctggacatgaatcacaatcttctgtcccagctgattcacacacatccaaagccacatctccaatgggtatcaccttcgccatgggggatacaagtgtttctacatcaactcctgccttctttgagactagaattcagactgaatcaacatcctctttgattcctggattaagggacaccaggacgtctgaggagatcaacactgtgacagagaccagcactgtcctttcagaagtgcccactactactactactgaggtctccaggacagaagttatcacttccagcagaacaaccatctcagggcctgatcattccaaaatgtcaccctacatctccacagaaaccatcaccaggctctccacttttccttttgtaacaggatccacagaaatggccatcaccaaccaaacaggtcctatagggactatctcacaggctacccttaccctggacacatcaagcacagcttcctgggaagggactcactcacctgtgactcagagatttccacactcagaggagaccactactatgagcagaagtactaagggcgtgtcatggcaaagccctccctctgtggaagaaaccagttctccttcttccccagtgcctttacctgcaataacctcacattcatctctttattccgcagtatcaggaagtagccccacttctgctctccctgtgacttcccttctcacctctggcaggaggaagaccatagacatgttggacacacactcagaacttgtgaccagctccttaccaagtgcaagtagcttctcaggtgagatactcacttctgaagcctccacaaatacagagacaattcacttttcagagaacacagcagaaaccaatatggggaccaccaattctatgcataaactacattcctctgtctcaatccactcccagccatccggacacacacctccaaaggttactggatctatgatggaggacgctattgtttccacatcaacacctggttctcctgagactaaaaatgttgacagagactcaacatcccctctgactcctgaactgaaagaggacagcaccgccctggtgatgaactcaactacagagtcaaacactgttttctccagtgtgtccctggatgctgctactgaggtctccagggcagaagtcacctactatgatcctacattcatgccagcttctgctcagtcaacaaagtccccagacatttcacctgaagccagcagcagtcattctaactctcctcccttgacaatatctacacacaagaccatcgccacacaaacaggtccttctggggtgacatctcttggccaactgaccctggacacatcaaccatagccacctcagcaggaactccatcagccagaactcaggattttgtagattcagaaacaaccagtgtcatgaacaatgatctcaatgatgtgttgaagacaagccctttctctgcagaagaagccaactctctctcttctcaggcacctctccttgtgacaacctcaccttctcctgtaacttccacattgcaagagcacagtacctcctctcttgtttctgtgacctcagtacccacccctacactggcgaagatcacagacatggacacaaacttagaacctgtgactcgttcacctcaaaatttaaggaacaccttggccacttcagaagccaccacagatacacacacaatgcatccttctataaacacagcagtggccaatgtggggaccaccagttcaccaaatgaattctattttactgtctcacctgactcagacccatataaagccacatccgcagtagttatcacttccacctcgggggactcaatagtttccacatcaatgcctagatcctctgcgatgaaaaagattgagtctgagacaactttctccctgatatttagactgagggagactagcacctcccagaaaattggctcatcctcagacacaagcacggtctttgacaaagcattcactgctgctactactgaggtctccagaacagaactcacctcctctagcagaacatccatccaaggcactgaaaagcccacaatgtcaccggacacctccacaagatctgtcaccatgctttctacttttgctggcctgacaaaatccgaagaaaggaccattgccacccaaacaggtcctcatagggcgacatcacagggtacccttacctgggacacatcaatcacaacctcacaggcagggacccactcagctatgactcatggattttcacaattagatttgtccactcttacgagtagagttcctgagtacatatcagggacaagcccaccctctgtggaaaaaaccagctcttcctcttcccttctgtctttaccagcaataacctcaccgtcccctgtacctactacattaccagaaagtaggccgtcttctcctgttcatctgacttcactccccacctctggcctagtgaagaccacagatatgctggcatctgtggccagtttacctccaaacttgggcagcacctcacataagataccgactacttcagaagacattaaagatacagagaaaatgtatccttccacaaacatagcagtaaccaatgtggggaccaccacttctgaaaaggaatcttattcgtctgtcccagcctactcagaaccacccaaagtcacctctccaatggttacctctttcaacataagggacaccattgtttccacatccatgcctggctcctctgagattacaaggattgagatggagtcaacattctccctggctcatgggctgaagggaaccagcacctcccaggaccccatcgtatccacagagaaaagtgctgtccttcacaagttgaccactggtgctactgagacctctaggacagaagttgcctcttctagaagaacatccattccaggccctgatcattccacagagtcaccagacatctccactgaagtgatccccagcctgcctatctcccttggcattacagaatcttcaaatatgaccatcatcactcgaacaggtcctcctcttggctctacatcacagggcacatttaccttggacacaccaactacatcctccagggcaggaacacactcgatggcgactcaggaatttccacactcagaaatgaccactgtcatgaacaaggaccctgagattctatcatggacaatccctccttctatagagaaaaccagcttctcctcttccctgatgccttcaccagccatgacttcacctcctgtttcctcaacattaccaaagaccattcacaccactccttctcctatgacctcactgctcacccctagcctagtgatgaccacagacacattgggcacaagcccagaacctacaaccagttcacctccaaatttgagcagtacctcacatgagatactgacaacagatgaagacaccacagctatagaagccatgcatccttccacaagcacagcagcgactaatgtggaaaccaccagttctggacatgggtcacaatcctctgtcctagctgactcagaaaaaaccaaggccacagctccaatggataccacctccaccatggggcatacaactgtttccacatcaatgtctgtttcctctgagactacaaaaattaagagagagtcaacatattccttgactcctggactgagagagaccagcatttcccaaaatgccagcttttccactgacacaagtattgttctttcagaagtccccactggtactactgctgaggtctccaggacagaagtcacctcctctggtagaacatccatccctggcccttctcagtccacagttttgccagaaatatccacaagaacaatgacaaggctctttgcctcgcccaccatgacagaatcagcagaaatgaccatccccactcaaacaggtccttctgggtctacctcacaggatacccttaccttggacacatccaccacaaagtcccaggcaaagactcattcaactttgactcagagatttccacactcagagatgaccactctcatgagcagaggtcctggagatatgtcatggcaaagctctccctctctggaaaatcccagctctctcccttccctgctgtctttacctgccacaacctcacctcctcccatttcctccacattaccagtgactatctcctcctctcctcttcctgtgacttcacttctcacctctagcccggtaacgaccacagacatgttacacacaagcccagaacttgtaaccagttcacctccaaagctgagccacacttcagatgagagactgaccactggcaaggacaccacaaatacagaagctgtgcatccttccacaaacacagcagcgtccaatgtggagattcccagctctggacatgaatccccttcctctgccttagctgactcagagacatccaaagccacatcaccaatgtttattacctccacccaggaggatacaactgttgccatatcaacccctcacttcttggagactagcagaattcagaaagagtcaatttcctccctgagccctaaattgagggagacaggcagttctgtggagacaagctcagccatagagacaagtgctgtcctttctgaagtgtccattggtgctactactgagatctccaggacagaagtcacctcctctagcagaacatccatctctggttctgctgagtccacaatgttgccagaaatatccaccacaagaaaaatcattaagttccctacttcccccatcctggcagaatcatcagaaatgaccatcaagacccaaacaagtcctcctgggtctacatcagagagtacctttacattagacacatcaaccactccctccttggtaataacccattcgactatgactcagagattgccacactcagagataaccactcttgtgagtagaggtgctggggatgtgccacggcccagctctctccctgtggaagaaacaagccctccatcttcccagctgtctttatctgccatgatctcaccttctcctgtttcttccacattaccagcaagtagccactcctcttctgcttctgtgacttcacttctcacaccaggccaagtgaagactactgaggtgttggacgcaagtgcagaacctgaaaccagttcacctccaagtttgagcagcacctcagttgaaatactggccacctctgaagtcaccacagatacggagaaaattcatcctttctcaaacacggcagtaaccaaagttggaacttccagttctggacatgaatccccttcctctgtcctacctgactcagagacaaccaaagccacatcggcaatgggtaccatctccattatgggggatacaagtgtttctacattaactcctgccttatctaacactaggaaaattcagtcagagccagcttcctcactgaccaccagattgagggagaccagcacctctgaagagaccagcttagccacagaagcaaacactgttctttctaaagtgtccactggtgctactactgaggtctccaggacagaagccatctcctttagcagaacatccatgtcaggccctgagcagtccacaatgtcacaagacatctccataggaaccatccccaggatttctgcctcctctgtcctgacagaatctgcaaaaatgaccatcacaacccaaacaggtccttcggagtctacactagaaagtacccttaatttgaacacagcaaccacaccctcttgggtggaaacccactctatagtaattcagggatttccacacccagagatgaccacttccatgggcagaggtcctggaggtgtgtcatggcctagccctccctttgtgaaagaaaccagccctccatcctccccgctgtctttacctgccgtgacctcacctcatcctgtttccaccacattcctagcacatatccccccctctccccttcctgtgacttcacttctcacctctggcccggcgacaaccacagatatcttgggtacaagcacagaacctggaaccagttcatcttcaagtttgagcaccacctcccatgagagactgaccacttacaaagacactgcacatacagaagccgtgcatccttccacaaacacaggagggaccaatgtggcaaccaccagctctggatataaatcacagtcctctgtcctagctgactcatctccaatgtgtaccacctccaccatgggggatacaagtgttctcacatcaactcctgccttccttgagactaggaggattcagacagagctagcttcctccctgacccctggattgagggagtccagcggctctgaagggaccagctcaggcaccaagatgagcactgtcctctctaaagtgcccactggtgctactactgagatctccaaggaagacgtcacctccatcccaggtcccgctcaatccacaatatcaccagacatctccacaagaaccgtcagctggttctctacatcccctgtcatgacagaatcagcagaaataaccatgaacacccatacaagtcctttaggggccacaacacaaggcaccagtactttggacacgtcaagcacaacctctttgacaatgacacactcaactatatctcaaggattttcacactcacagatgagcactcttatgaggaggggtcctgaggatgtatcatggatgagccctccccttctggaaaaaactagaccttccttttctctgatgtcttcaccagccacaacttcaccttctcctgtttcctccacattaccagagagcatctcttcctctcctcttcctgtgacttcactcctcacgtctggcttggcaaaaactacagatatgttgcacaaaagctcagaacctgtaaccaactcacctgcaaatttgagcagcacctcagttgaaatactggccacctctgaagtcaccacagatacagagaaaactcatccttcttcaaacagaacagtgaccgatgtggggacctccagttctggacatgaatccacttcctttgtcctagctgactcacagacatccaaagtcacatctccaatggttattacctccaccatggaggatacgagtgtctccacatcaactcctggcttttttgagactagcagaattcagacagaaccaacatcctccctgacccttggactgagaaagaccagcagctctgaggggaccagcttagccacagagatgagcactgtcctttctggagtgcccactggtgccactgctgaagtctccaggacagaagtcacctcctctagcagaacatccatctcaggctttgctcagctcacagtgtcaccagagacttccacagaaaccatcaccagactccctacctccagcataatgacagaatcagcagaaatgatgatcaagacacaaacagatcctcctgggtctacaccagagagtactcatactgtggacatatcaacaacacccaactgggtagaaacccactcgactgtgactcagagattttcacactcagagatgaccactcttgtgagcagaagccctggtgatatgttatggcctagtcaatcctctgtggaagaaaccagctctgcctcttccctgctgtctctgcctgccacgacctcaccttctcctgtttcctctacattagtagaggatttcccttccgcttctcttcctgtgacttctcttctcaaccctggcctggtgataaccacagacaggatgggcataagcagagaacctggaaccagttccacttcaaatttgagcagcacctcccatgagagactgaccactttggaagacactgtagatacagaagacatgcagccttccacacacacagcagtgaccaacgtgaggacctccatttctggacatgaatcacaatcttctgtcctatctgactcagagacacccaaagccacatctccaatgggtaccacctacaccatgggggaaacgagtgtttccatatccacttctgacttctttgagaccagcagaattcagatagaaccaacatcctccctgacttctggattgagggagaccagcagctctgagaggatcagctcagccacagagggaagcactgtcctttctgaagtgcccagtggtgctaccactgaggtctccaggacagaagtgatatcctctaggggaacatccatgtcagggcctgatcagttcaccatatcaccagacatctctactgaagcgatcaccaggctttctacttcccccattatgacagaatcagcagaaagtgccatcactattgagacaggttctcctggggctacatcagagggtaccctcaccttggacacctcaacaacaaccttttggtcagggacccactcaactgcatctccaggattttcacactcagagatgaccactcttatgagtagaactcctggagatgtgccatggccgagccttccctctgtggaagaagccagctctgtctcttcctcactgtcttcacctgccatgacctcaacttcttttttctccacattaccagagagcatctcctcctctcctcatcctgtgactgcacttctcacccttggcccagtgaagaccacagacatgttgcgcacaagctcagaacctgaaaccagttcacctccaaatttgagcagcacctcagctgaaatattagccacgtctgaagtcaccaaagatagagagaaaattcatccctcctcaaacacacctgtagtcaatgtagggactgtgatttataaacatctatccccttcctctgttttggctgacttagtgacaacaaaacccacatctccaatggctaccacctccactctggggaatacaagtgtttccacatcaactcctgccttcccagaaactatgatgacacagccaacttcctccctgacttctggattaagggagatcagtacctctcaagagaccagctcagcaacagagagaagtgcttctctttctggaatgcccactggtgctactactaaggtctccagaacagaagccctctccttaggcagaacatccaccccaggtcctgctcaatccacaatatcaccagaaatctccacggaaaccatcactagaatttctactcccctcaccacgacaggatcagcagaaatgaccatcacccccaaaacaggtcattctggggcatcctcacaaggtacctttaccttggacacatcaagcagagcctcctggccaggaactcactcagctgcaactcacagatctccacactcagggatgaccactcctatgagcagaggtcctgaggatgtgtcatggccaagccgcccatcagtggaaaaaactagccctccatcttccctggtgtctttatctgcagtaacctcaccttcgccactttattccacaccatctgagagtagccactcatctcctctccgggtgacttctcttttcacccctgtcatgatgaagaccacagacatgttggacacaagcttggaacctgtgaccacttcacctcccagtatgaatatcacctcagatgagagtctggccacttctaaagccaccatggagacagaggcaattcagctttcagaaaacacagctgtgactcagatgggcaccatcagcgctagacaagaattctattcctcttatccaggcctcccagagccatccaaagtgacatctccagtggtcacctcttccaccataaaagacattgtttctacaaccatacctgcttcctctgagataacaagaattgagatggagtcaacatccaccctgacccccacaccaagggagaccagcacctcccaggagatccactcagccacaaagccaagcactgttccttacaaggcactcactagtgccacgattgaggactccatgacacaagtcatgtcctctagcagaggacctagccctgatcagtccacaatgtcacaagacatatccactgaagtgatcaccaggctctctacctcccccatcaagacagaatctacagaaatgaccattaccacccaaacaggttctcctggggctacatcaaggggtacccttaccttggacacttcaacaacttttatgtcagggacccactcaactgcatctcaaggattttcacactcacagatgaccgctcttatgagtagaactcctggagatgtgccatggctaagccatccctctgtggaagaagccagctctgcctctttctcactgtcttcacctgtcatgacctcatcttctcccgtttcttccacattaccagacagcatccactcttcttcgcttcctgtgacatcacttctcacctcagggctggtgaagaccacagagctgttgggcacaagctcagaacctgaaaccagttcacccccaaatttgagcagcacctcagctgaaatactggccatcactgaagtcactacagatacagagaaactggagatgaccaatgtggtaacctcaggttatacacatgaatctccttcctctgtcctagctgactcagtgacaacaaaggccacatcttcaatgggtatcacctaccccacaggagatacaaatgttctcacatcaacccctgccttctctgacaccagtaggattcaaacaaagtcaaagctctcactgactcctgggttgatggagaccagcatctctgaagagaccagctctgccacagaaaaaagcactgtcctttctagtgtgcccactggtgctactactgaggtctccaggacagaagccatctcttctagcagaacatccatcccaggccctgctcaatccacaatgtcatcagacacctccatggaaaccatcactagaatttctacccccctcacaaggaaagaatcaacagacatggccatcacccccaaaacaggtccttctggggctacctcgcagggtacctttaccttggactcatcaagcacagcctcctggccaggaactcactcagctacaactcagagatttccacagtcagtggtgacaactcctatgagcagaggtcctgaggatgtgtcatggccaagcccgctgtctgtggaaaaaaacagccctccatcttccctggtatcttcatcttcagtaacctcaccttcgccactttattccacaccatctgggagtagccactcctctcctgtccctgtcacttctcttttcacctctatcatgatgaaggccacagacatgttggatgcaagtttggaacctgagaccacttcagctcccaatatgaatatcacctcagatgagagtctggccgcttctaaagccaccacggagacagaggcaattcacgtttttgaaaatacagcagcgtcccatgtggaaaccaccagtgctacagaggaactctattcctcttccccaggcttctcagagccaacaaaagtgatatctccagtggtcacctcttcctctataagagacaacatggtttccacaacaatgcctggctcctctggcattacaaggattgagatagagtcaatgtcatctctgacccctggactgagggagaccagaacctcccaggacatcacctcatccacagagacaagcactgtcctttacaagatgccctctggtgccactcctgaggtctccaggacagaagttatgccctctagcagaacatccattcctggccctgctcagtccacaatgtcactagacatctccgatgaagttgtcaccaggctgtctacctctcccatcatgacagaatctgcagaaataaccatcaccacccaaacaggttattctctggctacatcccaggttacccttcccttgggcacctcaatgacctttttgtcagggacccactcaactatgtctcaaggactttcacactcagagatgaccaatcttatgagcaggggtcctgaaagtctgtcatggacgagccctcgctttgtggaaacaactagatcttcctcttctctgacatcattacctctcacgacctcactttctcctgtgtcctccacattactagacagtagcccctcctctcctcttcctgtgacttcacttatcctcccaggcctggtgaagactacagaagtgttggatacaagctcagagcctaaaaccagttcatctccaaatttgagcagcacctcagttgaaataccggccacctctgaaatcatgacagatacagagaaaattcatccttcctcaaacacagcggtggccaaagtgaggacctccagttctgttcatgaatctcattcctctgtcctagctgactcagaaacaaccataaccataccttcaatgggtatcacctccgctgtggacgataccactgttttcacatcaaatcctgccttctctgagactaggaggattccgacagagccaacattctcattgactcctggattcagggagactagcacctctgaagagaccacctcaatcacagaaacaagtgcagtcctttatggagtgcccactagtgctactactgaagtctccatgacagaaatcatgtcctctaatagaatacacatccctgactctgatcagtccacgatgtctccagacatcatcactgaagtgatcaccaggctctcttcctcatccatgatgtcagaatcaacacaaatgaccatcaccacccaaaaaagttctcctggggctacagcacagagtactcttaccttggccacaacaacagcccccttggcaaggacccactcaactgttcctcctagatttttacactcagagatgacaactcttatgagtaggagtcctgaaaatccatcatggaagagctctctctttgtggaaaaaactagctcttcatcttctctgttgtccttacctgtcacgacctcaccttctgtttcttccacattaccgcagagtatcccttcctcctctttttctgtgacttcactcctcaccccaggcatggtgaagactacagacacaagcacagaacctggaaccagtttatctccaaatctgagtggcacctcagttgaaatactggctgcctctgaagtcaccacagatacagagaaaattcatccttcttcaagcatggcagtgaccaatgtgggaaccaccagttctggacatgaactatattcctctgtttcaatccactcggagccatccaaggctacatacccagtgggtactccctcttccatggctgaaacctctatttccacatcaatgcctgctaattttgagaccacaggatttgaggctgagccattttctcatttgacttctggatttaggaagacaaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtctgtaacagaaagtactcatcatctgagtacagatttgctgccttcagctgagactatttccactggcacagtgatgccttctctatcagaggccatgacttcatttgccaccactggagttccacgagccatctcaggttcaggtagtccattctctaggacagagtcaggccctggggatgctactctgtccaccattgcagagagcctgccttcatccactcctgtgccattctcctcttcaaccttcactaccactgattcttcaaccatcccagccctccatgagataacttcctcttcagctaccccatatagagtggacaccagtcttgggacagagagcagcactactgaaggacgcttggttatggtcagtactttggacacttcaagccaaccaggcaggacatcttcatcacccattttggataccagaatgacagagagcgttgagctgggaacagtgacaagtgcttatcaagttccttcactctcaacacggttgacaagaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctctgaagaccaccaccacagctctgaagaccacttccagagccaccttgaccaccagtgtctatactcccactttgggaacactgactcccctcaatgcatcaatgcaaatggccagcacaatccccacagaaatgatgatcacaaccccatatgttttccctgatgttccagaaacgacatcctcattggctaccagcctgggagcagaaaccagcacagctcttcccaggacaaccccatctgttttcaatagagaatcagagaccacagcctcactggtctctcgttctggggcagagagaagtccggttattcaaactctagatgtttcttctagtgagccagatacaacagcttcatgggttatccatcctgcagagaccatcccaactgtttccaagacaacccccaattttttccacagtgaattagacactgtatcttccacagccaccagtcatggggcagacgtcagctcagccattccaacaaatatctcacctagtgaactagatgcactgaccccactggtcactatttcggggacagatactagtacaacattcccaacactgactaagtccccacatgaaacagagacaagaaccacatggctcactcatcctgcagagaccagctcaactattcccagaacaatccccaatttttctcatcatgaatcagatgccacaccttcaatagccaccagtcctggggcagaaaccagttcagctattccaattatgactgtctcacctggtgcagaagatctggtgacctcacaggtcactagttctgggacagacagaaatatgactattccaactttgactctttctcctggtgaaccaaagacgatagcctcattagtcacccatcctgaagcacagacaagttcggccattccaacttcaactatctcgcctgctgtatcacggttggtgacctcaatggtcaccagtttggcggcaaagacaagtacaactaatcgagctctgacaaactcccctggtgaaccagctacaacagtttcattggtcacgcatcctgcacagaccagcccaacagttccctggacaacttccatttttttccatagtaaatcagacaccacaccttcaatgaccaccagtcatggggcagaatccagttcagctgttccaactccaa

SEQ ID NO: 4506 - DNA, 11374 bp, Artificial Sequence
  Synthetic polypeptide
tgtttcaactgaggtaccaggagtagtgacccctttggtcaccagttctagggcagtgatcagtacaactattccaattctgactctttctcctggtgaaccagagaccacaccttcaatggccaccagtcatggggaagaagccagttctgctattccaactccaactgtttcacctggggtaccaggagtggtgacctctctggtcactagttctagggcagtgactagtacaactattccaattctgactttttctcttggtgaaccagagaccacaccttcaatggccaccagtcatgggacagaagctggctcagctgttccaactgttttacctgaggtaccaggaatggtgacctctctggttgctagttctagggcagtaaccagtacaactcttccaactctgactctttctcctggtgaaccagagaccacaccttcaatggccaccagtcatggggcagaagccagctcaactgttccaactgtttcacctgaggtaccaggagtggtgacctctctggtcactagttctagtggagtaaacagtacaagtattccaactctgattctttctcctggtgaactagaaaccacaccttcaatggccaccagtcatggggcagaagccagctcagctgttccaactccaactgtttcacctggggtatcaggagtggtgacccctctggtcactagttccagggcagtgaccagtacaactattccaattctaactctttcttctagtgagccagagaccacaccttcaatggccaccagtcatggggtagaagccagctcagctgttctaactgtttcacctgaggtaccaggaatggtgacctctctggtcactagttctagagcagtaaccagtacaactattccaactctgactatttcttctgatgaaccagagaccacaacttcattggtcacccattctgaggcaaagatgatttcagccattccaactttagctgtctcccctactgtacaagggctggtgacttcactggtcactagttctgggtcagagaccagtgcgttttcaaatctaactgttgcctcaagtcaaccagagaccatagactcatgggtcgctcatcctgggacagaagcaagttctgttgttccaactttgactgtctccactggtgagccgtttacaaatatctcattggtcacccatcctgcagagagtagctcaactcttcccaggacaacctcaaggttttcccacagtgaattagacactatgccttctacagtcaccagtcctgaggcagaatccagctcagccatttcaacaactatttcacctggtataccaggtgtgctgacatcactggtcactagctctgggagagacatcagtgcaacttttccaacagtgcctgagtccccacatgaatcagaggcaacagcctcatgggttactcatcctgcagtcaccagcacaacagttcccaggacaacccctaattattctcatagtgaaccagacaccacaccatcaatagccaccagtcctggggcagaagccacttcagattttccaacaataactgtctcacctgatgtaccagatatggtaacctcacaggtcactagttctgggacagacaccagtataactattccaactctgactctttcttctggtgagccagagaccacaacctcatttatcacctattctgagacacacacaagttcagccattccaactctccctgtctcccctggtgcatcaaagatgctgacctcactggtcatcagttctgggacagacagcactacaactttcccaacactgacggagaccccatatgaaccagagacaacagccatacagctcattcatcctgcagagaccaacacaatggttcccaggacaactcccaagttttcccatagtaagtcagacaccacactcccagtagccatcaccagtcctgggccagaagccagttcagctgtttcaacgacaactatctcacctgatatgtcagatctggtgacctcactggtccctagttctgggacagacaccagtacaaccttcccaacattgagtgagaccccatatgaaccagagactacagccacgtggctcactcatcctgcagaaaccagcacaacggtttctgggacaattcccaacttttcccataggggatcagacactgcaccctcaatggtcaccagtcctggagtagacacgaggtcaggtgttccaactacaaccatcccacccagtataccaggggtagtgacctcacaggtcactagttctgcaacagacactagtacagctattccaactttgactccttctcctggtgaaccagagaccacagcctcatcagctacccatcctgggacacagactggcttcactgttccaattcggactgttccctctagtgagccagatacaatggcttcctgggtcactcatcctccacagaccagcacacctgtttccagaacaacctccagtttttcccatagtagtccagatgccacacctgtaatggccaccagtcctaggacagaagccagttcagctgtactgacaacaatctcacctggtgcaccagagatggtgacttcacagatcactagttctggggcagcaaccagtacaactgttccaactttgactcattctcctggtatgccagagaccacagccttattgagcacccatcccagaacagagacaagtaaaacatttcctgcttcaactgtgtttcctcaagtatcagagaccacagcctcactcaccattagacctggtgcagagactagcacagctctcccaactcagacaacatcctctctcttcaccctacttgtaactggaaccagcagagttgatctaagtccaactgcttcacctggtgtttctgcaaaaacagccccactttccacccatccagggacagaaaccagcacaatgattccaacttcaactctttcccttggtttactagagactacaggcttactggccaccagctcttcagcagagaccagcacgagtactctaactctgactgtttcccctgctgtctctgggctttccagtgcctctataacaactgataagccccaaactgtgacctcctggaacacagaaacctcaccatctgtaacttcagttggacccccagaattttccaggactgtcacaggcaccactatgaccttgataccatcagagatgccaacaccacctaaaaccagtcatggagaaggagtgagtccaaccactatcttgagaactacaatggttgaagccactaatttagctaccacaggttccagtcccactgtggccaagacaacaaccaccttcaatacactggctggaagcctctttactcctctgaccacacctgggatgtccaccttggcctctgagagtgtgacctcaagaacaagttataaccatcggtcctggatctccaccaccagcagttataaccgtcggtactggacccctgccaccagcactccagtgacttctacattctccccagggatttccacatcctccatccccagctccacagcagccacagtcccattcatggtgccattcaccctcaacttcaccatcaccaacctgcagtacgaggaggacatgcggcaccctggttccaggaagttcaacgccacagagagagaactgcagggtctgctcaaacccttgttcaggaatagcagtctggaatacctctattcaggctgcagactagcctcactcaggccagagaaggatagctcagccacggcagtggatgccatctgcacacatcgccctgaccctgaagacctcggactggacagagagcgactgtactgggagctgagcaatctgacaaatggcatccaggagctgggcccctacaccctggaccggaacagtctctatgtcaatggtttcacccatcgaagctctatgcccaccaccagcactcctgggacctccacagtggatgtgggaacctcagggactccatcctccagccccagccccacgactgctggccctctcctgatgccgttcaccctcaacttcaccatcaccaacctgcagtacgaggaggacatgcgtcgcactggctccaggaagttcaacaccatggagagtgtcctgcagggtctgctcaagcccttgttcaagaacaccagtgttggccctctgtactctggctgcagattgaccttgctcaggcccgagaaagatggggcagccactggagtggatgccatctgcacccaccgccttgaccccaaaagccctggactcaacagggagcagctgtactgggagctaagcaaactgaccaatgacattgaagagctgggcccctacaccctggacaggaacagtctctatgtcaatggtttcacccatcagagctctgtgtccaccaccagcactcctgggacctccacagtggatctcagaacctcagggactccatcctccctctccagccccacaattatggctgctggccctctcctggtaccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtctgagaaggatggagcagccactggagtggatgccatctgcatccatcatcttgaccccaaaagccctggactcaacagagagcggctgtactgggagctgagccaactgaccaatggcatcaaagagctgggcccctacaccctggacaggaacagtctctatgtcaatggtttcacccatcggacctctgtgcccaccagcagcactcctgggacctccacagtggaccttggaacctcagggactccattctccctcccaagccccgcaactgctggccctctcctggtgctgttcaccctcaacttcaccatcaccaacctgaagtatgaggaggacatgcatcgccctggctccaggaagttcaacaccactgagagggtcctgcagactctgcttggtcctatgttcaagaacaccagtgttggccttctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggcccctacaccctggacaggaacagtctctatgtcaatggtttcacccattggatccctgtgcccaccagcagcactcctgggacctccacagtggaccttgggtcagggactccatcctccctccccagccccacaactgctggccctctcctggtgccgttcaccctcaacttcaccatcaccaacctgaagtacgaggaggacatgcattgccctggctccaggaagttcaacaccacagagagagtcctgcagagtctgcttggtcccatgttcaagaacaccagtgttggccctctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctacatctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccactggaatggatgccatctgcagccaccgtcttgaccccaaaagccctggactcaacagagagcagctgtactgggagctgagccagctgacccatggcatcaaagagctgggcccctacaccctggacaggaacagtctctatgtcaatggtttcacccatcggagctctgtggcccccaccagcactcctgggacctccacagtggaccttgggacctcagggactccatcctccctccccagccccacaacagctgttcctctcctggtgccgttcaccctcaactttaccatcaccaatctgcagtatggggaggacatgcgtcaccctggctccaggaagttcaacaccacagagagggtcctgcagggtctgcttggtcccttgttcaagaactccagtgtcggccctctgtactctggctgcagactgatctctctcaggtctgagaaggatggggcagccactggagtggatgccatctgcacccaccaccttaaccctcaaagccctggactggacagggagcagctgtactggcagctgagccagatgaccaatggcatcaaagagctgggcccctacaccctggaccggaacagtctctacgtcaatggtttcacccatcggagctctgggctcaccaccagcactccttggacttccacagttgaccttggaacctcagggactccatcccccgtccccagccccacaaccaccggccctctcctggtgccattcacactcaacttcaccatcactaacctacagtatgaggagaacatgggtcaccctggctccaggaagttcaacatcacggagagtgttctgcagggtctgctcaagcccttgttcaagagcaccagtgttggccctctgtattctggctgcagactgaccttgctcaggcctgagaaggatggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccacagccactggccctgtcctgctgccattcaccctcaattttaccatcactaacctgcagtatgaggaggacatgcgtcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacccatgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctgacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctgcaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgcagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtccagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggagtcatcacatgcctgatctgcggtgtcctggctccacaagcagaagaatggcagaacgacacagcagagagaagagaaggagcatctgaatgccgaaaggagttcaactggggacagtcagagaggagactagccactggacagccaaactccaggggaagatcatcttcccactccatcccccttctagctccccatccatcccactgagaaccacctcccccattcaacaaaaccctggcattcatccttcaagtctatgtgtgacctgattcttcctggatgctggacaaggacttgggtaccaagagggcactgagctggttaacacttgagccatccacagacagcaaggctaaggagcacactgtaacacacagccacttgggctttgggagttgcagtctcccacctgtggatgctgccatggggccagagcccagggacactggccccggctcctgcacctgcctgtctgtgtgctccccgtcccataaggggtttgagtgcacccagcagccaaacagatgagccacacccctgtcacatgtcctgcaagggagctcagggaatcctcctgtttca

SEQ ID NO: 4507 - DNA, 4448 bp, Artificial Sequence
  Synthetic polypeptide
ccaccggccctctcctggtgccattcacactcaacttcaccatcactaacctacagtatgaggagaacatgggtcaccctggctccaggaagttcaacatcacggagagtgttctgcagggtctgctcaagcccttgttcaagagcaccagtgttggccctctgtattctggctgcagactgaccttgctcaggcctgagaaggatggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccacagccactggccctgtcctgctgccattcaccctcaattttaccatcactaacctgcagtatgaggaggacatgcgtcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacccatgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctgacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctgcaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgcagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtccagatgagcctcctacaaccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggagtcatcacatgcctgatctgcggtgtcctggctccacaagcagaagaatggcagaacgacacagcagagagaagagaaggagcatctgaatgccgaaaggagttcaactggggacagtcagagaggagactagccactggacagccaaactccaggggaagatcatcttcccactccatcccccttctagctccccatccatcccactgagaaccacctcccccattcaacaaaaccctggcattcatccttcaagtctatgtgtgacctgattcttcctggatgctggacaaggacttgggtaccaagagggcactgagctggttaacacttgagccatccacagacagcaaggctaaggagcacactgtaacacacagccacttgggctttgggagttgcagtctcccacctgtggatgctgccatggggccagagcccagggacactggccccggctcctgcacctgcctgtctgtgtgctccccgtcccataaggggtttgagtgcacccagcagccaaacagatgagccacacccctgtcacatgtcctgcaagggagctcagggaatcctcctgtttca

SEQ ID NO: 4508 - DNA, 3903 bp, Artificial Sequence
  Synthetic polypeptide
atgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacccatgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctgacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctgcaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgcagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtccagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggagtcatcacatgcctgatctgcggtgtcctggctccacaagcagaagaatggcagaacgacacagcagagagaagagaaggagcatctgaatgccgaaaggagttcaactggggacagtcagagaggagactagccactggacagccaaactccaggggaagatcatcttcccactccatcccccttctagctccccatccatcccactgagaaccacctcccccattcaacaaaaccctggcattcatccttcaagtctatgtgtgacctgattcttcctggatgctggacaaggacttgggtaccaagagggcactgagctggttaacacttgagccatccacagacagcaaggctaaggagcacactgtaacacacagccacttgggctttgggagttgcagtctcccacctgtggatgctgccatggggccagagcccagggacactggccccggctcctgcacctgcctgtctgtgtgctccccgtcccataaggggtttgagtgcacccagcagccaaacagatgagccacacccctgtcacatgtcctgcaagggagctcagggaatcctcctgtttca

SEQ ID NO: 4509 - DNA, 857 bp, Artificial Sequence; identical to SEQ ID NO: 1374
  Synthetic polypeptide

SEQ ID NO: 4510 - DNA, 211 bp, Artificial Sequence
  Synthetic polypeptide
atggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaacacagtggagcaaaaaaacacctagaataaccaacataaggggcaggaagaacagtttcatttt

SEQ ID NO: 4511 - DNA, 1281 bp, Artificial Sequence
  Synthetic polypeptide
atggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagcttttgcacagcaaaacaaacagcagagtaagcagacaacccacagagtgggagaaatttgcaaactatgcatccgacaaaggaataatatccagaatctataaggaactcaaatgagcaagaaaaaaataatcccattacaaagtggcaaagaacataaatagacaattctcaaaagaagatatacaagcagccaacgaacatgaaaaaatgctcaacatcgctaatcatcagggagatgttaagaccgcaatgagatatcaccttactcctgcaagaacgatcataattaaaaagtcaaaaaaacaatagatgttggtgtgaatgtggtgaaaagggaacacttctacactgctggtgggaatgtaaattagtacaaccactatgggaaacagtgcggagattccttaaagaacaaaaagtagaacaccatctgatccagcaatcccactacagggtatatacccaaaggaaaataagtcattatatgaaaaagacacatgcacacacgtttatagcagcacaattcacaattgcaaagatatagaaccaacctaagtgaccatcaaccaatgagtggataaagaaaatgtggtatattcatcgtggagtactactcttcagccataaaaaggaatgaaataatgtcttttgcagcaacttggatggagccagaggccattattctaagtaaagtaactcagaaatggaaaaccaaatattgtacctctcacaagtgggagctaagctatgagggctcaaaggcataagaatgatataatggactttagca

SEQ ID NO: 4512 - DNA, 1398 bp, Artificial Sequence
  Synthetic polypeptide
atgcaacagagccaggttcaagctctgagctgttttactccaaaggctgtggcaataagaactcctctgagaaatgtgtggccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagcttttgcacagcaaaacaaacagcagagtaagcagacaacccacagagtgggagaaatttgcaaactatgcatccgacaaaggaataatatccagaatctataaggaactcaaatgagcaagaaaaaaataatcccattacaaagtggcaaagaacataaatagacaattctcaaaagaagatatacaagcagccaacgaacatgaaaaaatgctcaacatcgctaatcatcagggagatgttaagaccgcaatgagatatcaccttactcctgcaagaacgatcataattaaaaagtcaaaaaaacaatagatgttggtgtgaatgtggtgaaaagggaacacttctacactgctggtgggaatgtaaattagtacaaccactatgggaaacagtgcggagattccttaaagaacaaaaagtagaacaccatctgatccagcaatcccactacagggtatatacccaaaggaaaataagtcattatatgaaaaagacacatgcacacacgtttatagcagcacaattcacaattgcaaagatatagaaccaacctaagtgaccatcaaccaatgagtggataaagaaaatgtggtatattcatcgtggagtactactcttcagccataaaaaggaatgaaataatgtcttttgcagcaacttggatggagccagaggccattattctaagtaaagtaactcagaaatggaaaaccaaatattgtacctctcacaagtgggagctaagctatgagggctcaaaggcataagaatgatataatggactttagca

SEQ ID NO: 4513 - DNA, 1374 bp, Artificial Sequence
  Synthetic polypeptide
atgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagcttttgcacagcaaaacaaacagcagagtaagcagacaacccacagagtgggagaaatttgcaaactatgcatccgacaaaggaataatatccagaatctataaggaactcaaatgagcaagaaaaaaataatcccattacaaagtggcaaagaacataaatagacaattctcaaaagaagatatacaagcagccaacgaacatgaaaaaatgctcaacatcgctaatcatcagggagatgttaagaccgcaatgagatatcaccttactcctgcaagaacgatcataattaaaaagtcaaaaaaacaatagatgttggtgtgaatgtggtgaaaagggaacacttctacactgctggtgggaatgtaaattagtacaaccactatgggaaacagtgcggagattccttaaagaacaaaaagtagaacaccatctgatccagcaatcccactacagggtatatacccaaaggaaaataagtcattatatgaaaaagacacatgcacacacgtttatagcagcacaattcacaattgcaaagatatagaaccaacctaagtgaccatcaaccaatgagtggataaagaaaatgtggtatattcatcgtggagtactactcttcagccataaaaaggaatgaaataatgtcttttgcagcaacttggatggagccagaggccattattctaagtaaagtaactcagaaatggaaaaccaaatattgtacctctcacaagtgggagctaagctatgagggctcaaaggcataagaatgatataatggactttagca

SEQ ID NO: 4514 - DNA, 1885 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgaggggg

SEQ ID NO: 4515 - DNA, 2107 bp, Artificial Sequence
  Synthetic polypeptide
atgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgtaagccgtggtttcgccttcgtggagttttatcacttgcaagatgctaccagctggatggaagccaatcagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagagagagagagagaga

SEQ ID NO: 4516 - DNA, 357 bp, Artificial Sequence
  Synthetic polypeptide
atgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggacaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggctgtaaagctttattgggagaattttaa

SEQ ID NO: 4517 - DNA, 2103 bp, Artificial Sequence
  Synthetic polypeptide
atgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgtaagccgtggtttcgccttcgtggagttttatcacttgcaagatgctaccagctggatggaagccaatcagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagagagagagaga

SEQ ID NO: 4518 - DNA, 2154 bp, Artificial Sequence; identical to SEQ ID NO: 1502
  Synthetic polypeptide

SEQ ID NO: 4519 - DNA, 2025 bp, Artificial Sequence; identical to SEQ ID NO: 1503
  Synthetic polypeptide

SEQ ID NO: 4520 - DNA, 490 bp, Artificial Sequence
  Synthetic polypeptide
atggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaagggacatctctgaaggtctctgccaactccagagctcccgccctgaggaatttgctgggcttttgttgcgactgcactggagttcgccttctcactctccccaaccctgcatctgtcatggcttcaatgatagttctaagagcactcccaataagcctctgagagatctctgcctcaaatctgtgcttcccttgttatccaacc

SEQ ID NO: 4521 - DNA, 301 bp, Artificial Sequence
  Synthetic polypeptide
gggggagggagtggtccttagctgaatgcgcctgcgttgtggcggcctccggcgccccaaggatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggctgaggcaggatcatcacttgaagctcggagtttgagaccagcctgggcaaaatagcaagaccccacccatttctacaaagaaacaagaa

SEQ ID NO: 4522 - DNA, 299 bp, Artificial Sequence
  Synthetic polypeptide
gttgtggcggcctccggcgccccaaggtactttctccccagcaaggaatccgcgtgcgcgatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggctgaggcaggatcatcacttgaagctcggagtttgagaccagcctgggcaaaatagcaagaccccacccatttctacaaagaaacaagaa

SEQ ID NO: 4523 - DNA, 410 bp, Artificial Sequence
  Synthetic polypeptide
atggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggctgaggcaggatcatcacttgaagctcggagtttgagaccagcctgggcaaaatagcaagaccccacccatttctacaaagaaacaagaa

SEQ ID NO: 4524 - DNA, 48 bp, Artificial Sequence
  Synthetic polypeptide
atgctccacgccctcctgcgatctagaatgccttatttaaaatagcac

SEQ ID NO: 4525 - DNA, 743 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagggccatccccaaacccatccccaagccaaactcaacaccatccccttccctaatcacctctcctgcccctagctcagcctcatccccaactccatgcctgtctccaatcccaaccctgcccccaatctcccctcaactccaa

SEQ ID NO: 4526 - DNA, 680 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttgtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagggccatccccaaacccatccccaagccaaactcaacaccatccccttccctaatcacctctcctgcccctagctcagcctcatccccaactccatgcctgtctccaatcccaaccctgcccccaatctcccctcaactccaa

SEQ ID NO: 4527 - DNA, 377 bp, Artificial Sequence
  Synthetic polypeptide
atgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggggtcatattact

SEQ ID NO: 4528 - DNA, 377 bp, Artificial Sequence
  Synthetic polypeptide
atgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggtaaatgctggacgccactgtggggctctgagagtcctgaattcttactgggttggggtcatattact

SEQ ID NO: 4529 - DNA, 611 bp, Artificial Sequence
  Synthetic polypeptide
aatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacaggcccggg

SEQ ID NO: 4530 - DNA, 288 bp, Artificial Sequence
  Synthetic polypeptide
atgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacaggcccggg

SEQ ID NO: 4531 - DNA, 475 bp, Artificial Sequence
  Synthetic polypeptide
atggacgcgctcaagtcggcggggcgggcgctgatccggagccccagcttggccaagcagagctgggggggcggtggccggcaccgcaagctgcctgagaactggacagacacgcgggagacgctgctggaggggatgctgttcagcctcaagtacctgggcatgacgctagtggagcagcccaagggtgaggagctgtcggccgccgccatcaagaggatcgtggctacagctaaggccagtgggaagaagctgcagaaggtgactctgaaggtgtcgccacggggaattatcctgacagacaacctcaccaaccagctcattgagaacgtgtccatatacaggatctcctattgcacagcagacaagatgcacgacaaggtgtttgcatacatcgcccagagccagcacaaccagagcctcgagtgccacgccttcctctgcaccaagcggaagatgagatcctgactaatac

SEQ ID NO: 4532 - DNA, 729 bp, Artificial Sequence
  Synthetic polypeptide
atgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtatttttttatagcaatacaagaa

SEQ ID NO: 4533 - DNA, 620 bp, Artificial Sequence
  Synthetic polypeptide
cgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtatttttttatagcaatacaagaa

SEQ ID NO: 4534 - DNA, 567 bp, Artificial Sequence
  Synthetic polypeptide
atgggactagctggcgtgtgcgccctgagacgctcagcgggctatatactcgtcggtggggccggcggtcagtctgcggcagcggcagcaagacggtacagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagagattacttcctccacccctccctatctca

SEQ ID NO: 4535 - DNA, 435 bp, Artificial Sequence
  Synthetic polypeptide
atgggactagctggcgtgtgcgccctgagacgctcagcgggctatatactcgtcggtggggccggcggtcagtctgcggcagcggcagcaagacggtacagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaaggttcggctcctggctgatcccactggggcctttgggaaggagacagacttattactagatgattcgctggtgtccatctttgggaatcgacgtctcaagagattacttcctccacccctccctatctca

SEQ ID NO: 4536 - DNA, 300 bp, Artificial Sequence
  Synthetic polypeptide
atgggactagctggcgtgtgcgccctgagacgctcagcgggctatatactcgtcggtggggccggcggtcagtctgcggcagcggcagcaagacggtacagtgaaggagagtgggcgtctggcggggtccgcagtttcagcagagccgctgcagccatggccccaatcaaggttcggctcctggctgatcccactggggcctttgggaaggagacagacttattactagatgattcgctggtgtccatctttgggaatcgacgtctcaagagattacttcctccacccctccctatctca

SEQ ID NO: 4537 - DNA, 1692 bp, Artificial Sequence; identical to SEQ ID NO: 1048
  Synthetic polypeptide

SEQ ID NO: 4538 - DNA, 1695 bp, Artificial Sequence; identical to SEQ ID NO: 1049
  Synthetic polypeptide

SEQ ID NO: 4539 - DNA, 466 bp, Artificial Sequence; identical to SEQ ID NO: 1050
  Synthetic polypeptide

SEQ ID NO: 4540 - DNA, 550 bp, Artificial Sequence
  Synthetic polypeptide
atggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaagaaaaaaaaagtgaaaaaaagaaacgaaaaggacagacgaagagtttaaagagaaaagggaaaaaagaaagaaaaagtaa

SEQ ID NO: 4541 - DNA, 2849 bp, Artificial Sequence; identical to SEQ ID NO: 1326
  Synthetic polypeptide

SEQ ID NO: 4542 - DNA, 1925 bp, Artificial Sequence; identical to SEQ ID NO: 1327
  Synthetic polypeptide

SEQ ID NO: 4543 - DNA, 2729 bp, Artificial Sequence; identical to SEQ ID NO: 1328
  Synthetic polypeptide

SEQ ID NO: 4544 - DNA, 2549 bp, Artificial Sequence; identical to SEQ ID NO: 1329
  Synthetic polypeptide

SEQ ID NO: 4545 - DNA, 583 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggggg

SEQ ID NO: 4546 - DNA, 520 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttgtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggggg

SEQ ID NO: 4547 - DNA, 1370 bp, Artificial Sequence
  Synthetic polypeptide
atggcggccctgggacatcttgctggggaggcagcggcggccccaggcccgggtactccctgcgcgtcccgcggagcccggcttcccggcccagtttccagcgcccggaatccttccactgtctgtctctgcccagagcaacctacgtgcagtaacgctgactccagagcgcacccgttgggcgatgaaggcggcacagcgtcgaaaaaacaaaagaataagaagaaaacgcggaacagggcctctgtggcaaatggaggcgagaaggcctcagagaaactcgccccagaagaagttcccctaagcgctgaggcccaggcacaacagttggcccaggaattggcttggtgtgtggagcaactggagctgggcctcaagaggcagaaacccaccccgaaacagaaagagcaggctattggagcaatccgaaccctgcgcagcaaaagaacgcccttgccccggaagaggcagctgatgcactccttgtttggagactatagggctcagatggaagccgaatggcgtgaggccctgcgggctctcagagctgctgcttattcagcccaggtgcaacctgtagatggagccaccagaaagaagagccaaagggtctgcaggcctcgctctatatggagagccaaagccactctggacatgcctgatgaagagtttagggccaccagagggcttggtctagcagtaacaccagtgtctgggaagatgcctgttgcaaagtggaccatggtctagcagtagcatcagtgtcaaggaaaaacacccactacttagcagactgggaaaaggagcctccctttccccgggggagtttagagaagactactcctccacctcttgtggagggcctgacatcagtcaggcccgcccgcagttatccagaggcctgtctccctgtgatgctgtgcttcagtggtcacgctcctagtccgctttcatgttccatcctgtatacctggctctgccttttagatagcaggagcaaattagtgaaagtactaaatgtctgatatgcagaaataatggcataagctgtctctctctcttctctctctctctgcctctgctgccaggcagggaagggccccctgtccagtggacacatgacccatgtgaccttacctattattggagatggttcacattccttaccctgcccctttgtcttatatccaataaatatcagtgcagcctggcatttggggccactactggtctccgcgtcttggtggtagtggtcccccaggcccaggtgtcttttcttttatctctttgtcttgtgtctttatttctacaatctctcatctctgcacatggggagaaaacccactgaccctgtggggctggaccctaca

SEQ ID NO: 4548 - DNA, 106 bp, Artificial Sequence
  Synthetic polypeptide
atgaccgataaaacagagaaggtgccgccgtctctcctccagcaaggtcaggacttcaggactgtgagtgggcagtttttccctggatgctttaatttcgccctgg

SEQ ID NO: 4549 - DNA, 958 bp, Artificial Sequence
  Synthetic polypeptide
atggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctactacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattct

SEQ ID NO: 4550 - DNA, 776 bp, Artificial Sequence
  Synthetic polypeptide
atggccgcgccggccccgggcctcatctcggtgttctcgagttcccaggagctgggtgcggcgctagcgcagctggtggcccagcgcgcagcatgctgcctggcaggggcccgcgcccgtttcgcgctcggcctgtcgggcgggagcctcgtctcgatgctagcccgcgagctacccgccgccgtcgcccctgccgggccagctagcttagcgcgctggacgctgggcttctgcgacgagcgcctcgtgcccttcgatcacgccgagagcacgtacggcctctaccggacgcatcttctctccagactgccgatcccagaaagccaggtgatcaccattaaccccgagctgcctgtggaggaggcggctgaggactacgccaagaagctgagacaggcattccaaggggactccatcccggttttcgacctgctgatcctgggggtgggccccgatggtcacacctgctcactcttcccagaccaccccctcctacaggagcgggagaagattgtggctcccatcagtgactccccgaagccaccgccacagcgtgtgaccctcacactacctgtcctgaatgcagcacgaactgtcatctttgtggcaactggagaaggcaaggcagctgttctgaagctactcaggaggctgaggcagaagaatcgcttgaaaccgggaggcggaggttgccgtgagccaagatcgtaccactgcactccagcctgggagacagagtgagactccatctcaaaataaataaataaataaataaa

SEQ ID NO: 4551 - DNA, 2647 bp, Artificial Sequence; identical to SEQ ID NO: 2625
  Synthetic polypeptide

SEQ ID NO: 4552 - DNA, 296 bp, Artificial Sequence
  Synthetic polypeptide
atggcggccaccatgaagaaggcggctgcagaagatgtcaatgttactttcgaagatcaacaaaagataaacaaatttgcacggaatacaagtagaatcacagagctgaaggaagaaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaagaattaatttaaaatatttttttt

SEQ ID NO: 4553 - DNA, 360 bp, Artificial Sequence
  Synthetic polypeptide
atgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggctgtaaagctttattgggagaattttaa

SEQ ID NO: 4554 - DNA, 1277 bp, Artificial Sequence; identical to SEQ ID NO: 2164
  Synthetic polypeptide

SEQ ID NO: 4555 - DNA, 1223 bp, Artificial Sequence; identical to SEQ ID NO: 2165
  Synthetic polypeptide

SEQ ID NO: 4556 - DNA, 1325 bp, Artificial Sequence; identical to SEQ ID NO: 2166
  Synthetic polypeptide

SEQ ID NO: 4557 - DNA, 914 bp, Artificial Sequence; identical to SEQ ID NO: 2167
  Synthetic polypeptide

SEQ ID NO: 4558 - DNA, 195 bp, Artificial Sequence
  Synthetic polypeptide
atggccaagccgtgtggggtgcgcctgagcggggaagcccgcaaacaggtggaggtcttcagacagaatcttttccaggagtcctttcattttcaggtcttcagtttcctcatttgcaagtcttggacccagtgatttccaaaggcccttccagttccatttgtcagacatctcattgagcatattctgtgattc

SEQ ID NO: 4559 - DNA, 266 bp, Artificial Sequence; identical to SEQ ID NO: 2578
  Synthetic polypeptide

SEQ ID NO: 4560 - DNA, 106 bp, Artificial Sequence; identical to SEQ ID NO: 4548
  Synthetic polypeptide

SEQ ID NO: 4561 - DNA, 791 bp, Artificial Sequence
  Synthetic polypeptide
atgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgcc

SEQ ID NO: 4562 - DNA, 721 bp, Artificial Sequence
  Synthetic polypeptide
cagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggatcatttatgcttgggaggtcgaggctgcagtgagtcatgattgtatgactgcactccagcctgggtgacagagcaagaccctgtttcaaaaagaaaaa

SEQ ID NO: 4563 - DNA, 1789 bp, Artificial Sequence
  Synthetic polypeptide
atggaagaaaacccgaccttggaatcagaagcctggggctcctctagggggtggctggccccccgggaggccagaggaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagggaggtgaaggtcgaagtgagccaagatcgtgccactgcactccagcctgggcgacagagcgagactccgtctcaaaaagagaaaacaaacaaacaacaacaa

SEQ ID NO: 4564 - DNA, 553 bp, Artificial Sequence
  Synthetic polypeptide
atgaagggtgggggcggtcagagggatgttggcgctgacaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagggaggtgaaggtcgaagtgagccaagatcgtgccactgcactccagcctgggcgacagagcgagactccgtctcaaaaagagaaaacaaacaaacaacaacaa

SEQ ID NO: 4565 - DNA, 1807 bp, Artificial Sequence
  Synthetic polypeptide
atggaagaaaacccgaccttggaatcagaagcctggggctcctctagggggtggctggccccccgggaggccagaggagccccctgctcctccccaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagggaggtgaaggtcgaagtgagccaagatcgtgccactgcactccagcctgggcgacagagcgagactccgtctcaaaaagagaaaacaaacaaacaacaacaa

SEQ ID NO: 4566 - DNA, 6132 bp, Artificial Sequence; identical to SEQ ID NO: 1117
  Synthetic polypeptide

SEQ ID NO: 4567 - DNA, 894 bp, Artificial Sequence
  Synthetic polypeptide
atggccgcggacgaagttgccggaggggcgcgcaaagccacgaaaagcaaactttttgagtttctggtccatggggtgcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggttctagtcctgagtctggactctgggtaagtgactcagcgattctgaaccttgtttccttatctttgaagtggagtgacaatacctgtcctatctactctcctgggcagttaggaaaatcaaattgctgcaaaagtgattgagcaaaattccaccaaaacagagaatattcttatt

SEQ ID NO: 4568 - DNA, 855 bp, Artificial Sequence
  Synthetic polypeptide
atgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggttctagtcctgagtctggactctgggtaagtgactcagcgattctgaaccttgtttccttatctttgaagtggagtgacaatacctgtcctatctactctcctgggcagttaggaaaatcaaattgctgcaaaagtgattgagcaaaattccaccaaaacagagaatattcttatt

SEQ ID NO: 4569 - DNA, 186 bp, Artificial Sequence; identical to SEQ ID NO: 2172
  Synthetic polypeptide

SEQ ID NO: 4570 - DNA, 437 bp, Artificial Sequence
  Synthetic polypeptide
atgtcttctcacaagactttcaggattaagcgattcctggccaagaaacaaaagcaaaatcgtcccattccccagtggattcggatgaaaactggaaataaaatcaggtccacgctgcttttatgagctgtaacacttaaccgccaaaatctgcagcttcacgcctgagcccagtgagactacgagcccactgggaggaatgaacaactccccacgcgctgccgtaagagctgtaacactcaccgggaaggtctgcagcttcactcttgagcaagtgagaccacgaacccaccagaagaaaaaaactccaaacacatctgaacatcagaagggacagactccagacgcgccaccttaagagctgtaacactcaccgcgagggtccgcggcttccttcttgaagtcagtgagaccaaaaacccaccaattccagacac

SEQ ID NO: 4571 - DNA, 382 bp, Artificial Sequence
  Synthetic polypeptide
atggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacagggcaacctccatcctagcatctgctgctgtgagggtgggcatgtgtctgggtctacgtctcacacctccgctggaccagagctgctttggggtagaagctggctgtct

SEQ ID NO: 4572 - DNA, 601 bp, Artificial Sequence
  Synthetic polypeptide
atgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacagggcaacctccatcctagcatctgctgctgtgagggtgggcatgtgtctgggtctacgtctcacacctccgctggaccagagctgctttggggtagaagctggctgtct

SEQ ID NO: 4573 - DNA, 457 bp, Artificial Sequence
  Synthetic polypeptide
cacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacagggcaacctccatcctagcatctgctgctgtgagggtgggcatgtgtctgggtctacgtctcacacctccgctggaccagagctgctttggggtagaagctggctgtct

SEQ ID NO: 4574 - DNA, 222 bp, Artificial Sequence
  Synthetic polypeptide
ggaaggaaatggcctcaggcttcagcaaggggcccaccctggggctgctgcccgacgtgccctccctgatggagacactcagctacagctactgctacgtgggaatcatgacagggcaacctccatcctagcatctgctgctgtgagggtgggcatgtgtctgggtctacgtctcacacctccgctggaccagagctgctttggggtagaagctggctgtct

SEQ ID NO: 4575 - DNA, 299 bp, Artificial Sequence
  Synthetic polypeptide
ttcttgctgcattcatcatcacctctgactggatacccctgggggtcaatagtcaacgaggagacgatgtgactcaagcgactccagaaacattcacagaagatcctaatctggtgaatgatcccgctacagatgaaacagtttgcttgcacttgctgtccttccaccatgggatgactctcatcagatgatggcaccatgttcttggacttctcagcctccagaactgtgagaaataaatttcttttctttataaattactcagttggtgacagactcaataacacaaaatagactaa

SEQ ID NO: 4576 - DNA, 330 bp, Artificial Sequence
  Synthetic polypeptide
atgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagtttgcttgcacttgctgtccttccaccatgggatgactctcatcagatgatggcaccatgttcttggacttctcagcctccagaactgtgagaaataaatttcttttctttataaattactcagttggtgacagactcaataacacaaaatagactaa

SEQ ID NO: 4577 - DNA, 294 bp, Artificial Sequence
  Synthetic polypeptide
atgtcgctcttgggacccaaggtgctgctgtttcttgctgcattcatcatcacctctgacgatgtgactcaagcgactccagaaacattcacagaagatcctaatctggtgaatgatcccgctacagatgaaacagtttgcttgcacttgctgtccttccaccatgggatgactctcatcagatgatggcaccatgttcttggacttctcagcctccagaactgtgagaaataaatttcttttctttataaattactcagttggtgacagactcaataacacaaaatagactaa

SEQ ID NO: 4578 - DNA, 91 bp, Artificial Sequence; identical to SEQ ID NO: 223
  Synthetic polypeptide

SEQ ID NO: 4579 - DNA, 104 bp, Artificial Sequence
  Synthetic polypeptide
atgagggcgcggccgcaggtctgcgaggcgctgctcttcgccctggcgctccagaccggcgtgtgctatggcatcaagtggctgcttgcgaaaagggagtgaga

SEQ ID NO: 4580 - DNA, 1193 bp, Artificial Sequence
  Synthetic polypeptide
atggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggccct

SEQ ID NO: 4581 - DNA, 1181 bp, Artificial Sequence
  Synthetic polypeptide
atggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggccct

SEQ ID NO: 4582 - DNA, 106 bp, Artificial Sequence; identical to SEQ ID NO: 4548
  Synthetic polypeptide

SEQ ID NO: 4583 - DNA, 397 bp, Artificial Sequence; identical to SEQ ID NO: 3335
  Synthetic polypeptide

SEQ ID NO: 4584 - DNA, 289 bp, Artificial Sequence; identical to SEQ ID NO: 3336
  Synthetic polypeptide

SEQ ID NO: 4585 - DNA, 1106 bp, Artificial Sequence
  Synthetic polypeptide
atgaatgagtgtcactatgacaagcacatggactttttttataataggagcaacactgatactgtcgatgactggacaggaacaaagcttgtgattgttttgtgtgttgggacgtttttctgcctgtttatttttttttctaattctctggtcatcgcggcagtgatcaaaaacagaaaatttcatttccccttctactacctgttggctaatttagctgctgccgatttcttcgctggaattgcctatgtattcctgatgtttaacacaggcccagtttcaaaaactttgactgtcaaccgctggtttctccgtcaggggcttctggacagtagcttgactgcttccctcaccaacttgctggttatcgccgtggagaggcacatgtcaatcatgaggatgcgggtccatagcaacctgaccaaaaagagggtgacactgctcattttgcttgtctgggccatcgccatttttatgggggcggtccccacactgggctggaattgcctctgcaacatctctgcctgctcttccctggcccccatttacagcaggagttaccttgttttctggacagtgtccaacctcatggccttcctcatcatggttgtggtgtacctgcggatctacgtgtacgtcaagaggaaaaccaacgtcttgtctccgcatacaagtgggtccatcagccgccggaggacacccatgaagctaatgaagacggtgatgactgtcttaggggcgtttgtggtatgctggaccccgggcctggtggttctgctcctcgacggcctgaactgcaggcagtgtggcgtgcagcatgtgaaaaggtggttcctgctgctggcgctgctcaactccgtcgtgaaccccatcatctactcctacaaggacgaggacatgtatggcaccatgaagaagatgatctgctgcttctctcaggagaacccagagaggcgtccctctcgcatcccctccacagtcctcagcaggagtgacacaggcagccagtacatagaggatagtattagccaagatcgcagcactgcactctagtctgggtgacagagcaagactctgtctcaaaaaaaaaaaaaaaaaaaaaaaaa

SEQ ID NO: 4586 - DNA, 657 bp, Artificial Sequence
  Synthetic polypeptide
atgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggctggcggggagattcagagaaccgaggcgtggaaagcaccgaga

SEQ ID NO: 4587 - DNA, 313 bp, Artificial Sequence
  Synthetic polypeptide
cccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggctggcggggagattcagagaaccgaggcgtggaaagcaccgaga

SEQ ID NO: 4588 - DNA, 390 bp, Artificial Sequence
  Synthetic polypeptide
atgtcggactacagcacgggaggacccccgcccgggccgccgccgcccgccggcgggggcgggggagccggaggcgccgggggaggccctccgccgggcccgccaggcgcgggggaccggggcggcggcggtcccggcggcggcggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcgttgccaccttccaacctacctcacaggggtgttgtgggga

SEQ ID NO: 4589 - DNA, 218 bp, Artificial Sequence
  Synthetic polypeptide
cctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcgttgccaccttccaacctacctcacaggggtgttgtgggga

SEQ ID NO: 4590 - DNA, 81 bp, Artificial Sequence
  Synthetic polypeptide
atgactcggaaagcgctcagaagaacgcttcgcccgttggtgctatacgtcctggggtagaaacagcttccagcaacaccc

SEQ ID NO: 4591 - DNA, 1248 bp, Artificial Sequence
  Synthetic polypeptide
atggcggccccggagccggcgccgaggcgggcccgggaacgggagcgggagcgggaggacgagagcgaggacgagagcgacatcctggaggaaagcccgtgtggtcgctggcaaaagcgacgggagcaggtaaaccaagggaacatgccagggcttcagagcaccttcctagccatggacacggaggagggggtagaggtggtgtggaacgagctccacttcggagacaggaaggccttcgcggcgcacgaggagaagatccagaccgtgttcgagcagctggtgctggtggaccacccgaacatcgtgaagttgcacaagtactggctggatacctctgaggcctgcgcgagggtcatcttcatcacagagtacgtgtcatcaggcagcctcaagcaattcctcaaaaagaccaagaagaaccacaaggccatgaacgcccgggcctggaagcgctggtgcacgcagatcctgtctgcgctcagcttcctgcacgcctgcagccccccaatcatccacgggaacctgaccagcgacaccatcttcattcagcacaacggcctcatcaagatcggctccgtgtggcaccgaatcttctccaatgcacttccagatgatctccgaagccccatccgcgctgagcgagaggaacttcggaacctgcacttcttccccccagagtatggagaggtggccgatgggaccgctgtggacatcttctcctttgggatgtgtgcgctggagatggctgtactggaaatccagaccaatggggacacccgggtcacagaggaggccattgctcgcgccaggcactcgctgagtgaccccaacatgcgggagttcatcctttgctgcctggcccgggaccctgcccgccggccctctgcccacagcctcctcttccaccgcgtgctcttcgaggtgcactcgctgaagctcctggcagcccactgcttcatccagcaccagtacctcatgcctgagaatgtggtggaggagaagaccaaggccatggacctgcacgcggtcttggcggagcttccccggccccgcaggcccccgctgcagtggcggtactcggaagtctccttcatggagctggacaaattcctggaggatgtcagctcctggctccctgcctctctcccactccactcctggctcagtcttagagatttctatgccctcatggattctacccctgccttcctggcctcttgattcttggcttgcctctcctccaat

SEQ ID NO: 4592 - DNA, 519 bp, Artificial Sequence
  Synthetic polypeptide
atgtgtgcgctggagatggctgtactggaaatccagaccaatggggacacccgggtcacagaggaggccattgctcgcgccaggcactcgctgagtgaccccaacatgcgggagttcatcctttgctgcctggcccgggaccctgcccgccggccctctgcccacagcctcctcttccaccgcgtgctcttcgaggtgcactcgctgaagctcctggcagcccactgcttcatccagcaccagtacctcatgcctgagaatgtggtggaggagaagaccaaggccatggacctgcacgcggtcttggcggagcttccccggccccgcaggcccccgctgcagtggcggtactcggaagtctccttcatggagctggacaaattcctggaggatgtcagctcctggctccctgcctctctcccactccactcctggctcagtcttagagatttctatgccctcatggattctacccctgccttcctggcctcttgattcttggcttgcctctcctccaat

SEQ ID NO: 4593 - DNA, 809 bp, Artificial Sequence
  Synthetic polypeptide
atgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagaggtttgaactgcactggtccactgatagacaaagtttcttctgactgtgccaccccaagacagcaagaccaacccgttttcctcctcctcctcagcctactcgacgcgaagatgacaaggatgaagatctttatgatgatccacttccacttaatgaatagtaaacatagttttttctttcttatgagtttcctgatagcattccttttctctagcttactttattgtaagagtataatacatatagcagacaaaatatgcgttaatcaactgtttatgttatcactaaggcttcaggtaaacagaaggctattagtagttaagctctgggggagtcaaaagttatacatggatttttagctgcagggaggctggcacccctaacctccacgttgttcaagattcaatt

SEQ ID NO: 4594 - DNA, 836 bp, Artificial Sequence
  Synthetic polypeptide
atgcggggctctggtctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagaggtttgaactgcactggtccactgatagacaaagtttcttctgactgtgccaccccaagacagcaagaccaacccgttttcctcctcctcctcagcctactcgacgcgaagatgacaaggatgaagatctttatgatgatccacttccacttaatgaatagtaaacatagttttttctttcttatgagtttcctgatagcattccttttctctagcttactttattgtaagagtataatacatatagcagacaaaatatgcgttaatcaactgtttatgttatcactaaggcttcaggtaaacagaaggctattagtagttaagctctgggggagtcaaaagttatacatggatttttagctgcagggaggctggcacccctaacctccacgttgttcaagattcaatt

SEQ ID NO: 4595 - DNA, 512 bp, Artificial Sequence
  Synthetic polypeptide
atgcttcgaactctggcccaagccaagaaggaatgctgggatcggttcctccaggagaagttagcttcagagttctttgtggatggacttgattctgatgagaggtttgaactgcactggtccactgatagacaaagtttcttctgactgtgccaccccaagacagcaagaccaacccgttttcctcctcctcctcagcctactcgacgcgaagatgacaaggatgaagatctttatgatgatccacttccacttaatgaatagtaaacatagttttttctttcttatgagtttcctgatagcattccttttctctagcttactttattgtaagagtataatacatatagcagacaaaatatgcgttaatcaactgtttatgttatcactaaggcttcaggtaaacagaaggctattagtagttaagctctgggggagtcaaaagttatacatggatttttagctgcagggaggctggcacccctaacctccacgttgttcaagattcaatt

SEQ ID NO: 4596 - DNA, 106 bp, Artificial Sequence; identical to SEQ ID NO: 4548
  Synthetic polypeptide

SEQ ID NO: 4597 - DNA, 154 bp, Artificial Sequence; identical to SEQ ID NO: 2227
  Synthetic polypeptide

SEQ ID NO: 4598 - DNA, 3992 bp, Artificial Sequence; identical to SEQ ID NO: 120
  Synthetic polypeptide

SEQ ID NO: 4599 - DNA, 3845 bp, Artificial Sequence; identical to SEQ ID NO: 121
  Synthetic polypeptide

SEQ ID NO: 4600 - DNA, 314 bp, Artificial Sequence; identical to SEQ ID NO: 998
  Synthetic polypeptide

SEQ ID NO: 4601 - DNA, 1221 bp, Artificial Sequence; identical to SEQ ID NO: 122
  Synthetic polypeptide

SEQ ID NO: 4602 - DNA, 999 bp, Artificial Sequence; identical to SEQ ID NO: 983
  Synthetic polypeptide

SEQ ID NO: 4603 - DNA, 868 bp, Artificial Sequence
  Synthetic polypeptide
atgatgctccggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagcggaagcttctaccacacctgtggcggtagcctcatcgcccccgactgggttgtgactgccggccactgcatctcgagctcccggacctaccaggtggtgttgggcgagtacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctccggctggtgacatccttcccaacgagacaccctgctacatcaccggctggggccgtctctataccaacgggccactcccagacaagctgcaggaggccctgctgccggtggtggactatgaacactgctccaggtggaactggtggggttcctccgtgaagaagaccatggtgtgtgctggaggggacatccgctccggctgcaatggtgactctggaggacccctcaactgccccacagaggatggtggctggcaggtccatggcgtgaccagctttgtttctgcctttggctgcaacacccgcaggaagcccacggtgttcactcgagtctccgccttcattgactggattgaggaggggctgtgcagaatggaaaccacacttgcctgtctcccaggaagccaggtgaggctgtgtgctgatttctggc

SEQ ID NO: 4604 - DNA, 577 bp, Artificial Sequence
  Synthetic polypeptide
caggtgatccccatcaactctggggacctctttgtgcatccactctggaaccgctcgtgtgtggcctgtggcaatgacatcgccctcatcaagctctcacgcagcgcccagctgggagacgccgtccagctcgcctcactccctccggctggtgacatccttcccaacgagacaccctgctacatcaccggctggggccgtctctataccaacgggccactcccagacaagctgcaggaggccctgctgccggtggtggactatgaacactgctccaggtggaactggtggggttcctccgtgaagaagaccatggtgtgtgctggaggggacatccgctccggctgcaatggtgactctggaggacccctcaactgccccacagaggatggtggctggcaggtccatggcgtgaccagctttgtttctgcctttggctgcaacacccgcaggaagcccacggtgttcactcgagtctccgccttcattgactggattgaggaggggctgtgcagaatggaaaccacacttgcctgtctcccaggaagccaggtgaggctgtgtgctgatttctggc

SEQ ID NO: 4605 - DNA, 569 bp, Artificial Sequence; identical to SEQ ID NO: 426
  Synthetic polypeptide

SEQ ID NO: 4606 - DNA, 154 bp, Artificial Sequence; identical to SEQ ID NO: 2227
  Synthetic polypeptide

SEQ ID NO: 4607 - DNA, 942 bp, Artificial Sequence
  Synthetic polypeptide
atgattaggaccctgctgctgtccactttggtggctggagccctcagttgtggggtctccacttacgcgcctgatatgtctaggatgcttggaggtgaagaagcgaggcccaacagctggccctggcaggtctccctgcagtacagctccaatggccagtggtaccacacctgcggagggtccctgatagccaacagctgggtcctgacggctgcccactgcatcagctcctccgggatctaccgcgtgatgctgggccagcataacctctacgttgcagagtccggctcgctggccgtcagtgtctctaagattgtggtgcacaaggactggaactccgaccaggtctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctctccctgatgacctgaagcagggccagttgctggttgtggactatgccacctgctccagctctggctggtggggcagcaccgtgaagacgaatatgatctgtgctgggggtgatggcgtgatatgcacctgcaacggagactccggtgggccgctgaactgtcaggcatctgacggccggtgggaggtgcatggcatcggcagcctcacgtcggtccttggttgcaactactactacaagccctccatcttcacgcgggtctccaactacaacgactggatcaattcgccatggtggtgcatgcctgtagtctcagctgcttgggaggctgaggtggaaggatcgctttggcccaagaggtggagcctacagtaagccaaggtcgcaccactgcactgcagcctgagcgacatagcaagaccctgtctctgaaaataa

SEQ ID NO: 4608 - DNA, 734 bp, Artificial Sequence; identical to SEQ ID NO: 930
  Synthetic polypeptide

SEQ ID NO: 4609 - DNA, 510 bp, Artificial Sequence; identical to SEQ ID NO: 1633
  Synthetic polypeptide

SEQ ID NO: 4610 - DNA, 607 bp, Artificial Sequence; identical to SEQ ID NO: 2299
  Synthetic polypeptide

SEQ ID NO: 4611 - DNA, 577 bp, Artificial Sequence; identical to SEQ ID NO: 2300
  Synthetic polypeptide

SEQ ID NO: 4612 - DNA, 604 bp, Artificial Sequence; identical to SEQ ID NO: 2301
  Synthetic polypeptide

SEQ ID NO: 4613 - DNA, 834 bp, Artificial Sequence
  Synthetic polypeptide
atgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcagtatactccttcaacttattaaagaaaaataaaacagcctcaggcagatccttcaggaagtattccagaagaagacatgttatcataggagatgacagcttcatgcatgttattgcccctgaaaaccttccagggaacaagatgtggaagtggaagacagtgatattgatgatcctgaccctgtgtaggcctaggctaatgcaggtgtttgtgtcttagtttttaacaaaaaattttgacaagttaaaaaaattatcataaaaatggttatagaatcaagatataaagaagtaaaataatttgatacagggatacagagtgttttaagctaaaggttattacaaaaagttaaaagtttaaaaaaaataaaaattgt

SEQ ID NO: 4614 - DNA, 201 bp, Artificial Sequence
  Synthetic polypeptide
atgattaggaccctgctgctgtccactttggtggctggagccctcagttgtggggtctccacttacgcgcctgatatgtctaggatgcttggaggtgaagaagcgaggcccaacagctggccctggcaggttttgggtgcccccttaagttgtgtacctgaggtgagtgcctcactcccccttacccttgtcccagccccg

SEQ ID NO: 4615 - DNA, 153 bp, Artificial Sequence
  Synthetic polypeptide
tgtggggtctccacttacgcgcctgatatgtctaggatgcttggaggtgaagaagcgaggcccaacagctggccctggcaggttttgggtgcccccttaagttgtgtacctgaggtgagtgcctcactcccccttacccttgtcccagccccg

SEQ ID NO: 4616 - DNA, 3934 bp, Artificial Sequence; identical to SEQ ID NO: 1150
  Synthetic polypeptide

SEQ ID NO: 4617 - DNA, 3787 bp, Artificial Sequence; identical to SEQ ID NO: 1151
  Synthetic polypeptide

SEQ ID NO: 4618 - DNA, 867 bp, Artificial Sequence; identical to SEQ ID NO: 1152
  Synthetic polypeptide

SEQ ID NO: 4619 - DNA, 996 bp, Artificial Sequence; identical to SEQ ID NO: 1153
  Synthetic polypeptide

SEQ ID NO: 4620 - DNA, 1158 bp, Artificial Sequence; identical to SEQ ID NO: 1301
  Synthetic polypeptide

SEQ ID NO: 4621 - DNA, 2927 bp, Artificial Sequence; identical to SEQ ID NO: 3132
  Synthetic polypeptide

SEQ ID NO: 4622 - DNA, 2930 bp, Artificial Sequence; identical to SEQ ID NO: 3133
  Synthetic polypeptide

SEQ ID NO: 4623 - DNA, 201 bp, Artificial Sequence
  Synthetic polypeptide
atgataaggacgctgctgctgtccactttggtggctggagccctcagttgtggggaccccacttacccaccttatgtgactagggtggttggcggtgaagaagcgaggcccaacagctggccctggcaggttttgggtgcccccttaagttgtgtacctgaggtgagtgcctcactcccccttacccttgtcccagccccg

SEQ ID NO: 4624 - DNA, 1288 bp, Artificial Sequence; identical to SEQ ID NO: 1042
  Synthetic polypeptide

SEQ ID NO: 4625 - DNA, 931 bp, Artificial Sequence; identical to SEQ ID NO: 1043
  Synthetic polypeptide

SEQ ID NO: 4626 - DNA, 850 bp, Artificial Sequence; identical to SEQ ID NO: 1044
  Synthetic polypeptide

SEQ ID NO: 4627 - DNA, 1954 bp, Artificial Sequence; identical to SEQ ID NO: 1045
  Synthetic polypeptide

SEQ ID NO: 4628 - DNA, 1873 bp, Artificial Sequence; identical to SEQ ID NO: 1046
  Synthetic polypeptide

SEQ ID NO: 4629 - DNA, 1888 bp, Artificial Sequence; identical to SEQ ID NO: 1047
  Synthetic polypeptide

SEQ ID NO: 4630 - DNA, 476 bp, Artificial Sequence
  Synthetic polypeptide
atgtgcggacctgacgacagatgccccgcacgctggccgggaccgggaagggcggtcaagtgtggaaagggtctggcggctgccaggcctggcagagtggagcggggcggggcgcagcggggcggggcgggcctggagctgcacccgcttctgggtggacgcacttggcgagcggcgcgggatgcagacggctgcgaggcgctgggcacagttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacggcaattaactcaaacttctcaggaagacagtgtgaataccagtgagtatttaacactctacctctggtaactgtagagtgtatagacagagctgagaaccgctg

SEQ ID NO: 4631 - DNA, 341 bp, Artificial Sequence
  Synthetic polypeptide
atgagagagacaagtggcttcacattgaagaaggggaggagtgcgccattggttttccatcctccagatgcactgattgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacggcaattaactcaaacttctcaggaagacagtgtgaataccagtgagtatttaacactctacctctggtaactgtagagtgtatagacagagctgagaaccgctg

SEQ ID NO: 4632 - DNA, 347 bp, Artificial Sequence
  Synthetic polypeptide
atgcacatgagagagacaagtggcttcacattgaagaaggggaggagtgcgccattggttttccatcctccagatgcactgattgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacggcaattaactcaaacttctcaggaagacagtgtgaataccagtgagtatttaacactctacctctggtaactgtagagtgtatagacagagctgagaaccgctg

SEQ ID NO: 4633 - DNA, 284 bp, Artificial Sequence
  Synthetic polypeptide
atgggacctgcgggggaggttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacggcaattaactcaaacttctcaggaagacagtgtgaataccagtgagtatttaacactctacctctggtaactgtagagtgtatagacagagctgagaaccgctg

SEQ ID NO: 4634 - DNA, 305 bp, Artificial Sequence
  Synthetic polypeptide
atgaatccattcctgatccttgcctttgtgggagctgctgttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacggcaattaactcaaacttctcaggaagacagtgtgaataccagtgagtatttaacactctacctctggtaactgtagagtgtatagacagagctgagaaccgctg

SEQ ID NO: 4635 - DNA, 630 bp, Artificial Sequence
  Synthetic polypeptide
atggctttcctctggctcctctcctgctgggccctcctgggtaccaccttcggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgacacggagaagcggagaagaccaccatctgcaagccaaggaaagaggcctcagaagaaacaaccctgctaataccttgatctcggccgccatgcctctagaactgtgagaaaatacatttctgttgtttaagctacccagttggtagtacagcagccctagcaaagtaaca

SEQ ID NO: 4636 - DNA, 369 bp, Artificial Sequence
  Synthetic polypeptide
gagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgacacggagaagcggagaagaccaccatctgcaagccaaggaaagaggcctcagaagaaacaaccctgctaataccttgatctcggccgccatgcctctagaactgtgagaaaatacatttctgttgtttaagctacccagttggtagtacagcagccctagcaaagtaaca

SEQ ID NO: 4637 - DNA, 474 bp, Artificial Sequence
  Synthetic polypeptide
gacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgacacggagaagcggagaagaccaccatctgcaagccaaggaaagaggcctcagaagaaacaaccctgctaataccttgatctcggccgccatgcctctagaactgtgagaaaatacatttctgttgtttaagctacccagttggtagtacagcagccctagcaaagtaaca

SEQ ID NO: 4638 - DNA, 378 bp, Artificial Sequence
  Synthetic polypeptide
gtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgacacggagaagcggagaagaccaccatctgcaagccaaggaaagaggcctcagaagaaacaaccctgctaataccttgatctcggccgccatgcctctagaactgtgagaaaatacatttctgttgtttaagctacccagttggtagtacagcagccctagcaaagtaaca

SEQ ID NO: 4639 - DNA, 2961 bp, Artificial Sequence; identical to SEQ ID NO: 3268
  Synthetic polypeptide

SEQ ID NO: 4640 - DNA, 2964 bp, Artificial Sequence; identical to SEQ ID NO: 3269
  Synthetic polypeptide

SEQ ID NO: 4641 - DNA, 235 bp, Artificial Sequence; identical to SEQ ID NO: 1657
  Synthetic polypeptide

SEQ ID NO: 4642 - DNA, 1078 bp, Artificial Sequence; identical to SEQ ID NO: 1658
  Synthetic polypeptide

SEQ ID NO: 4643 - DNA, 213 bp, Artificial Sequence
  Synthetic polypeptide
atgttgggcatcactgtcctcgctgcgctcttggcctgtgccaggcgtggtggcgggcacctgtaatcccaactactcagaaggctgaggcaggagaattgcttgaacccaggaggaggttgcagtgagccgagatcgcgccatcaaactccagcctgggcaacaagagtgaaactccgtctcaaaaaaaaaaaaaaaagaaaaagaaagaaa

SEQ ID NO: 4644 - DNA, 485 bp, Artificial Sequence
  Synthetic polypeptide
atgctgcccccttggaccctcggccttctcctgctggccacagtcagagggagaaaagtctgctacggacaacttggctgcttttctgatgaaaaaccatgggcaggaacccttcagcgacctgtaaaattacttccctggtcccccgaggacattgacacccgctttcttctgtacacaaatgaaaatccaaacaacttccaactaatcactggcacggaaccagacaccattgaggcttcaaacttccaactggaccgcaagacacgcttcatcatccatggcttcttagacaaggcggaggacagctggccatcggacatgtgcaagaaaatgtttgaagtggagaaggtgaactgcatctgtgtggactggaggcacgggtcccgggcaatgtacacccaagccgtgcaaaacattcgggttgttggggcggagacagctttcttaatacaagcactgtcggctgttctgcaagggtcaga

SEQ ID NO: 4645 - DNA, 484 bp, Artificial Sequence
  Synthetic polypeptide
atgctgcccccttggaccctcggccttctcctgctggccacagtcagaggaaaagagtctgctacggacaacttggctgcttttctgatgaaaaaccatgggcaggaacccttcagcgacctgtaaaattacttccctggtcccccgaggacattgacacccgctttcttctgtacacaaatgaaaatccaaacaacttccaactaatcactggcacggaaccagacaccattgaggcttcaaacttccaactggaccgcaagacacgcttcatcatccatggcttcttagacaaggcggaggacagctggccatcggacatgtgcaagaaaatgtttgaagtggagaaggtgaactgcatctgtgtggactggaggcacgggtcccgggcaatgtacacccaagccgtgcaaaacattcgggttgttggggcggagacagctttcttaatacaagcactgtcggctgttctgcaagggtcaga

SEQ ID NO: 4646 - DNA, 489 bp, Artificial Sequence
  Synthetic polypeptide
atgatgtggtccaacttcttcctgcaagaggagaaccggcggcggggggccgcgggccggcggcgggcgcacgggcagggcaggtcggggctgacgcccgagcgcgaggggaaggtgaagctggcgctgctgctggccgccgtgggcgccacgctggcggtgctgtccgtgggcaccgagttctgggtggagctcaacacctacaaggccaacggcagcgccgtgtgcgaagcggcccacctggggctgtggaaggcgtgcaccaagcggctgtggcaggcggacgtgcccgtggacagggacacctgcggccccgcggagctgcccggagaagcaaactgcacctattttaaattcttcaccacgggggagaatgcacgcatctttcagagaaccacaaagaaagtgactttagagaaataactgaccctttctgagtcttaattccttcaacagtgtaagtaaaatgttgggctggatgatactcta

SEQ ID NO: 4647 - DNA, 728 bp, Artificial Sequence
  Synthetic polypeptide
atgggtggtatcctgcacagcccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgatacaaacgtgtcagttttctcagttgaca

SEQ ID NO: 4648 - DNA, 1385 bp, Artificial Sequence
  Synthetic polypeptide
atggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgtcctgcacagcccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgatacaaacgtgtcagttttctcagttgaca

SEQ ID NO: 4649 - DNA, 1124 bp, Artificial Sequence
  Synthetic polypeptide
atggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgatacaaacgtgtcagttttctcagttgaca

SEQ ID NO: 4650 - DNA, 839 bp, Artificial Sequence
  Synthetic polypeptide
atggatttcggactggccctcctgctggcggggcttctggggctcctcctcgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgatacaaacgtgtcagttttctcagttgaca

SEQ ID NO: 4651 - DNA, 979 bp, Artificial Sequence
  Synthetic polypeptide
atgtgcggacctgacgacagatgccccgcacgctggccgggaccgggaagggcggtcaagtgtggaaagggtctggcggctgccaggcctggcagagtggagcggggcggggcgcagcggggcggggcgggcctggagctgcacccgcttctgggtggacgcacttggcgagcggcgcgggatgcagacggctgcgaggcgctgggcacagttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttcctcgagggaggcaagaagagctggagattaagtcaatcaccaatgagcaatgatttaataaaccatgcctataaaatggagtctccataaaaaccctaaataacagggtttggagaggttccaagtcagtgaatgcatccacatggtaggagggtggtgcatcccaaactccaggggacagcagctcctgtgctcaggaccctttgggaccttgcccggtgtccctcttcatctggctgttcat

SEQ ID NO: 4652 - DNA, 850 bp, Artificial Sequence
  Synthetic polypeptide
atgcacatgagagagacaagtggcttcacattgaagaaggggaggagtgcgccattggttttccatcctccagatgcactgattgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttcctcgagggaggcaagaagagctggagattaagtcaatcaccaatgagcaatgatttaataaaccatgcctataaaatggagtctccataaaaaccctaaataacagggtttggagaggttccaagtcagtgaatgcatccacatggtaggagggtggtgcatcccaaactccaggggacagcagctcctgtgctcaggaccctttgggaccttgcccggtgtccctcttcatctggctgttcat

SEQ ID NO: 4653 - DNA, 787 bp, Artificial Sequence
  Synthetic polypeptide
atgggacctgcgggggaggttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttcctcgagggaggcaagaagagctggagattaagtcaatcaccaatgagcaatgatttaataaaccatgcctataaaatggagtctccataaaaaccctaaataacagggtttggagaggttccaagtcagtgaatgcatccacatggtaggagggtggtgcatcccaaactccaggggacagcagctcctgtgctcaggaccctttgggaccttgcccggtgtccctcttcatctggctgttcat

SEQ ID NO: 4654 - DNA, 808 bp, Artificial Sequence
  Synthetic polypeptide
atgaatccattcctgatccttgcctttgtgggagctgctgttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttcctcgagggaggcaagaagagctggagattaagtcaatcaccaatgagcaatgatttaataaaccatgcctataaaatggagtctccataaaaaccctaaataacagggtttggagaggttccaagtcagtgaatgcatccacatggtaggagggtggtgcatcccaaactccaggggacagcagctcctgtgctcaggaccctttgggaccttgcccggtgtccctcttcatctggctgttcat

SEQ ID NO: 4655 - DNA, 934 bp, Artificial Sequence
  Synthetic polypeptide
atgataaggacgctgctgctgtccactttggtggctggagccctcagttgtggggaccccacttacccaccttatgtgactagggtggttggcggtgaagaagcgaggcccaacagctggccctggcaggtctccctgcagtacagctccaatggcaagtggtaccacacctgcggagggtccctgatagccaacagctgggtcctgacggctgcccactgcatcagctcctccaggacctaccgcgtggggctgggccggcacaacctctacgttgcggagtccggctcgctggcagtcagtgtctctaagattgtggtgcacaaggactggaactccaaccaaatctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcgctactcaggaggctgaggcaggggaatcacttgaacctgggaggtggaggttgcagtaacccgagttcgcaccactgcactccagcctgggcgacagagcgagactccatctcaaaagaaaaaaaaacacacaaaaaagaaa

SEQ ID NO: 4656 - DNA, 506 bp, Artificial Sequence; identical to SEQ ID NO: 1096
  Synthetic polypeptide

SEQ ID NO: 4657 - DNA, 285 bp, Artificial Sequence; identical to SEQ ID NO: 1623
  Synthetic polypeptide

SEQ ID NO: 4658 - DNA, 197 bp, Artificial Sequence; identical to SEQ ID NO: 3411
  Synthetic polypeptide

SEQ ID NO: 4659 - DNA, 2151 bp, Artificial Sequence; identical to SEQ ID NO: 127
  Synthetic polypeptide

SEQ ID NO: 4660 - DNA, 1833 bp, Artificial Sequence; identical to SEQ ID NO: 126
  Synthetic polypeptide

SEQ ID NO: 4661 - DNA, 681 bp, Artificial Sequence; identical to SEQ ID NO: 911
  Synthetic polypeptide

SEQ ID NO: 4662 - DNA, 285 bp, Artificial Sequence; identical to SEQ ID NO: 1623
  Synthetic polypeptide

SEQ ID NO: 4663 - DNA, 4024 bp, Artificial Sequence; identical to SEQ ID NO: 1712
  Synthetic polypeptide

SEQ ID NO: 4664 - DNA, 4060 bp, Artificial Sequence; identical to SEQ ID NO: 1713
  Synthetic polypeptide

SEQ ID NO: 4665 - DNA, 2267 bp, Artificial Sequence; identical to SEQ ID NO: 2277
  Synthetic polypeptide

SEQ ID NO: 4666 - DNA, 2264 bp, Artificial Sequence; identical to SEQ ID NO: 2278
  Synthetic polypeptide

SEQ ID NO: 4667 - DNA, 731 bp, Artificial Sequence; identical to SEQ ID NO: 2279
  Synthetic polypeptide

SEQ ID NO: 4668 - DNA, 1565 bp, Artificial Sequence; identical to SEQ ID NO: 2280
  Synthetic polypeptide

SEQ ID NO: 4669 - DNA, 1528 bp, Artificial Sequence
  Synthetic polypeptide
atgcccgccctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaagacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacagaagaccgggagctggccacagtgcatcatcagtacctgatacgaatttcctggttgactcactcactcactgcctgtctctcctgccaatggtggcaattccttgagggcagggact

SEQ ID NO: 4670 - DNA, 1034 bp, Artificial Sequence
  Synthetic polypeptide
atgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggtactcgggaggctgaggcaggagaagcgcctgaacccgggaggcggaggttgtggtgagctgatctcgtgccattgcactccagcgtgggcaacaagagcgaaactccatctcaaaaaaaaaaaaaaaaa

SEQ ID NO: 4671 - DNA, 1586 bp, Artificial Sequence
  Synthetic polypeptide
atgctccggctcctccggccgctgctgctactgctgctgctgcctcccccggggtcccctgagccccccggcctgacccagctgtccccgggggcgcccccgcaggcccccgacttgctctacgctgacgggctgcgcgcctacgcggccggggcttgggcgccggccgtggcgctgctgcgggaggcgctgcggagccaggcggcgctgggccgggtgcggctggattgcggggcgagctgcgcggccgatccgggcgccgcgctccccgccgtgcttctcggggccccggagcccgactccgggccgggacccacgcaggggtcctgggagcgacagcttctccgtgcagcgctccgccgcgcagactgcctgacccagtgcgcagcacggaggctgggccccgggggcgcggcgcgccgcgtggggagcgcgctccgggacgccttccgccgtcgggagccctacaactacctgcagagggcctattaccagttgaagaagctggatctggcagctgcggcagcacacaccttctttgtagcaaaccccatgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggtactcgggaggctgaggcaggagaagcgcctgaacccgggaggcggaggttgtggtgagctgatctcgtgccattgcactccagcgtgggcaacaagagcgaaactccatctcaaaaaaaaaaaaaaaaa

SEQ ID NO: 4672 - DNA, 1588 bp, Artificial Sequence
  Synthetic polypeptide
atgctccggctcctccggccgctgctgctactgctgctgctgcctcccccggggtcccctgagccccccggcctgacccagctgtccccgggggcgcccccgcaggcccccgacttgctctacgctgacgggctgcgcgcctacgcggccggggcttgggcgccggccgtggcgctgctgcgggaggcgctgcggagccaggcggcgctgggccgggtgcggctggattgcggggcgagctgcgcggccgatccgggcgccgcgctccccgccgtgcttctcggggccccggagcccgactccgggccgggacccacgcaggggtcctgggagcgacagcttctccgtgcagcgctccgccgcgcagactgcctgacccagtgcgcagcacggaggctgggccccgggggcgcggcgcgcttcgcgtggggagcgcgctccgggacgccttccgccgtcgggagccctacaactacctgcagagggcctattaccagttgaagaagctggatctggcagctgcggcagcacacaccttctttgtagcaaaccccatgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggtactcgggaggctgaggcaggagaagcgcctgaacccgggaggcggaggttgtggtgagctgatctcgtgccattgcactccagcgtgggcaacaagagcgaaactccatctcaaaaaaaaaaaaaaaaa

SEQ ID NO: 4673 - DNA, 500 bp, Artificial Sequence; identical to SEQ ID NO: 919
  Synthetic polypeptide

SEQ ID NO: 4674 - DNA, 1063 bp, Artificial Sequence; identical to SEQ ID NO: 2221
  Synthetic polypeptide

SEQ ID NO: 4675 - DNA, 581 bp, Artificial Sequence
  Synthetic polypeptide
atggccgggccgggctcgccgcgccgcgcgtcccggggggcctcggcgcttctcgctgccgcgcttctctacgccgcgctgggggacgtggtgcgctcggagcagcagataccgctctccgtggtgaagctctgggcctcggcttttggtggggagataaaatccattgctgctaagtactccggttcccagcttctgcaaaaggtatacactgcaaaagaacagaaagaagagactgaaatagagactggcacaacaatgttcttagcaggattatccacaatagccaaaggtggaaacagcccgaatgtgcatcaacagatgagtgaattaataaaatgtgatatatgcatacaatggaattttcaaccataaaaaggaatgaatttttcatacatgctacaacatggataagccttgaaaacataatgcaaagtgaaataaatcagacacaaaaggacaaacattgtgtgattctacttatacgaagtacctggaataggcgaattcctagagacagaaagtagaatagaggttaccaggaactgagtggaggggagaatggggtattatttttttat

SEQ ID NO: 4676 - DNA, 394 bp, Artificial Sequence; identical to SEQ ID NO: 3032
  Synthetic polypeptide

SEQ ID NO: 4677 - DNA, 410 bp, Artificial Sequence; identical to SEQ ID NO: 2219
  Synthetic polypeptide

SEQ ID NO: 4678 - DNA, 392 bp, Artificial Sequence; identical to SEQ ID NO: 2220
  Synthetic polypeptide

SEQ ID NO: 4679 - DNA, 2142 bp, Artificial Sequence
  Synthetic polypeptide
atgcagccaacgctgcttctcagcctcctgggagccgtggggctggcggctgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggagacagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggaggaatctgaggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggccagcacccacccccctcaggtggagagacactgaggcacatattctgcactgcctcccagacttcctctgtggatcatgccccaggtgccacagcagtgacctgcccaataatgcagcctttattggctgcctttaccttttccactgcccactggtgaccctgctggtgtttcctgggatcatctctcatataaactgcttgttttcaaatacttgtctcagggtttgctcctgggggaccctgacctaaga

SEQ ID NO: 4680 - DNA, 1180 bp, Artificial Sequence; identical to SEQ ID NO: 1340
  Synthetic polypeptide

SEQ ID NO: 4681 - DNA, 607 bp, Artificial Sequence; identical to SEQ ID NO: 2299
  Synthetic polypeptide

SEQ ID NO: 4682 - DNA, 577 bp, Artificial Sequence; identical to SEQ ID NO: 2300
  Synthetic polypeptide

SEQ ID NO: 4683 - DNA, 604 bp, Artificial Sequence; identical to SEQ ID NO: 2301
  Synthetic polypeptide

SEQ ID NO: 4684 - DNA, 226 bp, Artificial Sequence
  Synthetic polypeptide
atgagacagagcggcgcctcccagcccctgctgatcaacatgtacctgccagatcccgtcggagacggtctcttcaaggacgggaagaacccgagctgggggccgctgagccccgcggttcagaaagggcgcccggctgagatggagagtggcggcggatatctgtccttgctcgccttggaaagccaagtgccttggtgcgccgctgcgctcacgtggggggagg

SEQ ID NO: 4685 - DNA, 1913 bp, Artificial Sequence; identical to SEQ ID NO: 3276
  Synthetic polypeptide

SEQ ID NO: 4686 - DNA, 2460 bp, Artificial Sequence; identical to SEQ ID NO: 3277
  Synthetic polypeptide

SEQ ID NO: 4687 - DNA, 1394 bp, Artificial Sequence
  Synthetic polypeptide
atgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgttccagctattcgggaggatgaggcaggagaatcgcttgaacccaggaggtggaggttgcagtgagccgagattgcaccactgcgctccagctt

SEQ ID NO: 4688 - DNA, 1367 bp, Artificial Sequence
  Synthetic polypeptide
atgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgttccagctattcgggaggatgaggcaggagaatcgcttgaacccaggaggtggaggttgcagtgagccgagattgcaccactgcgctccagctt

SEQ ID NO: 4689 - DNA, 1370 bp, Artificial Sequence
  Synthetic polypeptide
atgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgttccagctattcgggaggatgaggcaggagaatcgcttgaacccaggaggtggaggttgcagtgagccgagattgcaccactgcgctccagctt

SEQ ID NO: 4690 - DNA, 1505 bp, Artificial Sequence
  Synthetic polypeptide
atgcagatccggttattaagagccgagctggtggttcccctctggcaattcatcaggcagtggccccctgggagtgatggatggggacaaatggaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgttccagctattcgggaggatgaggcaggagaatcgcttgaacccaggaggtggaggttgcagtgagccgagattgcaccactgcgctccagctt

SEQ ID NO: 4691 - DNA, 1511 bp, Artificial Sequence
  Synthetic polypeptide
atgggcgggaagggaggaggggacacgagaggccctgtcctcttcccgtgccagcttgctcaggccctcagtcccagacgggcttttcccagagagctaaaagagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgttccagctattcgggaggatgaggcaggagaatcgcttgaacccaggaggtggaggttgcagtgagccgagattgcaccactgcgctccagctt

SEQ ID NO: 4692 - DNA, 1439 bp, Artificial Sequence
  Synthetic polypeptide
atggactctcaaggggactgggctgcacaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgttccagctattcgggaggatgaggcaggagaatcgcttgaacccaggaggtggaggttgcagtgagccgagattgcaccactgcgctccagctt

SEQ ID NO: 4693 - DNA, 1524 bp, Artificial Sequence
  Synthetic polypeptide
atgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagaatggctgcagtggaggactggctcctgctccccagaatccttgtcatcaagagggacaactaccagcttgggacagcgggaagaccctggcctggccttggtcatttagggtcctgctggcccttttcctgggccccttgggagggaggagggctcccgggcctgagtggtgctgttcaccatactccttcctttgaggactacaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgttccagctattcgggaggatgaggcaggagaatcgcttgaacccaggaggtggaggttgcagtgagccgagattgcaccactgcgctccagctt

SEQ ID NO: 4694 - DNA, 734 bp, Artificial Sequence; identical to SEQ ID NO: 930
  Synthetic polypeptide

SEQ ID NO: 4695 - DNA, 2800 bp, Artificial Sequence
  Synthetic polypeptide
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgatttactctccaactttctccagttactgtatgtttcaaagagtgaacctccaaagagtgaatcaatgggcttgcttgctctctggcttccaggtgaattcagccagtggaaccatggcaggagatcagagggaggaaatacaatgagatcaaggaatgtatttccatggtttcttccctgcagcatcacagcagtgggcatgtacctttcccagacctcttacctcttattacactactctctccatagagctctcttttacctaggtctccaataaccattccttctcctttcctcttcaaggttaggggtagtaacattatcccactttttctgcctcgagattattaaagttttccttatgtttttgctggacacccctcctttgtaaagagtatgtcactttattaaactcaaatgaaacccaatttgtgctatctcttttccaacaagatcatgacttatata

SEQ ID NO: 4696 - DNA, 605 bp, Artificial Sequence
  Synthetic polypeptide
tgtagctggtgtggttgctggaattgttcttattggccttgcattactgctgatatggaagcttttaatgataattcatgacagaagggagtttgctaaatttgaaaaggagaaaatgaatgccaaatgggacacgatttactctccaactttctccagttactgtatgtttcaaagagtgaacctccaaagagtgaatcaatgggcttgcttgctctctggcttccaggtgaattcagccagtggaaccatggcaggagatcagagggaggaaatacaatgagatcaaggaatgtatttccatggtttcttccctgcagcatcacagcagtgggcatgtacctttcccagacctcttacctcttattacactactctctccatagagctctcttttacctaggtctccaataaccattccttctcctttcctcttcaaggttaggggtagtaacattatcccactttttctgcctcgagattattaaagttttccttatgtttttgctggacacccctcctttgtaaagagtatgtcactttattaaactcaaatgaaacccaatttgtgctatctcttttccaacaagatcatgacttatata

SEQ ID NO: 4697 - DNA, 1447 bp, Artificial Sequence
  Synthetic polypeptide
atggccgggccgggctcgccgcgccgcgcgtcccggggggcctcggcgcttctcgctgccgcgcttctctacgccgcgctgggggacgtggtgcgctcggagcagcagataccgctctccgtggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggtacatggtccagacagaacagtcacgagatgcagcagccttcatcagcctgggtccctgagtgagcacatggagcagatgactttcactgccccttgcatctgccaacccacactggattataaatagtgttcatgacaaataaacttttatgttaagccactgagatttttagtttgatatgttcttatagcataactt

SEQ ID NO: 4698 - DNA, 1165 bp, Artificial Sequence
  Synthetic polypeptide
atggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggtacatggtccagacagaacagtcacgagatgcagcagccttcatcagcctgggtccctgagtgagcacatggagcagatgactttcactgccccttgcatctgccaacccacactggattataaatagtgttcatgacaaataaacttttatgttaagccactgagatttttagtttgatatgttcttatagcataactt

SEQ ID NO: 4699 - DNA, 1105 bp, Artificial Sequence
  Synthetic polypeptide
atgcagcaggagggaggacccgtgaggagcgccccctgtaggaccggaaccctggagggttcgcggcaagggtctccggggcataggaaacgggcatcccccaagggtagtctgagttccgcccagccccattcctggatgctcacgccgtctcccctaaactcccactgcgctcaccgggagcccatctcatcatcaccacagcccgtggctaatgggccaaaacagaagaagaaaagcaactggcggagtacaacgcgcctgcgcattatcagactcagggacaggctggaacctcgccccctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagttgacattaaggtcatcaaagacctaccttggcctccacctgtgggacagctggacagcagcccctccctgcctgatggggacagggacatctccggtccagcctcgcccctccctgagcccagcctggaggacagcagcgcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaactgtcatactctaggagtct

SEQ ID NO: 4700 - DNA, 1135 bp, Artificial Sequence
  Synthetic polypeptide
atggtggcccaaagtctctctgacgctcaccatgccctgactatcatgctatctgaacgactttggctgggactggagctcttaaattttacaagaaggaaaatcagttctgacccaccaccatacaacttccttgaggcgcgagaggcggcattgggtcaccgctggaggatgcagcaggagggaggacccgtgaggagcgccccctgtaggaccggaaccctggagggttcgcggcaagggtctccggggcataggaaacgggcatcccccaagggtagtctgagttccgcccagccccattcctggatgctcacgccgtctcccctaaactcccactgcgctcaccgggagcccatctcatcatcaccacagcccgtggctaatgggccaaaacagaagaagaaaagcaactggcggagtacaacgcgcctgcgcattatcagactcagggacaggctggaacctcgccccctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaactgtcatactctaggagtct

SEQ ID NO: 4701 - DNA, 553 bp, Artificial Sequence
  Synthetic polypeptide
atggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaactgtcatactctaggagtct

SEQ ID NO: 4702 - DNA, 324 bp, Artificial Sequence
  Synthetic polypeptide
ccccctggccccgggagtcccgcctgccagaggatgatgagaggccccctgaggagtatgaccagccctgggagtggaagaaggagcggatttccaaagcctttgcaggggacacccacaatgggtgggcctggacagcgagggacccagcagagatgccccccttcctctctctcatccttagctggtatcacggggccatcagccgaaccgacgccgagaacctgctccggctgtgcaaagaggccagctacctggtgcgcaacagtgagaccagcaagaatgacttctccctctccctcaactgtcatactctaggagtct

SEQ ID NO: 4703 - DNA, 615 bp, Artificial Sequence
  Synthetic polypeptide
ctggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaactgtcatactctaggagtct

SEQ ID NO: 4704 - DNA, 2648 bp, Artificial Sequence; identical to SEQ ID NO: 3730
  Synthetic polypeptide

SEQ ID NO: 4705 - DNA, 2636 bp, Artificial Sequence; identical to SEQ ID NO: 3731
  Synthetic polypeptide

SEQ ID NO: 4706 - DNA, 565 bp, Artificial Sequence; identical to SEQ ID NO: 3732
  Synthetic polypeptide

SEQ ID NO: 4707 - DNA, 1898 bp, Artificial Sequence; identical to SEQ ID NO: 2282
  Synthetic polypeptide

SEQ ID NO: 4708 - DNA, 1865 bp, Artificial Sequence; identical to SEQ ID NO: 2283
  Synthetic polypeptide

SEQ ID NO: 4709 - DNA, 764 bp, Artificial Sequence; identical to SEQ ID NO: 2284
  Synthetic polypeptide

SEQ ID NO: 4710 - DNA, 746 bp, Artificial Sequence
  Synthetic polypeptide
atggcagaaatggagaaagaagggagacctcccgaaaataaacggagcaggaagccggctcacccagtgaaaagggagatcaatgaggagatgaagaactttgcagaaaacaccatgaatgaactccttggctggtatggctatgataaggttgaattaaaagatggtgaggatattgaattcaggagctaccctacagatggggagagccggcagcacatttctgttctcaaagaaaattctttgccaaaaccaaaattacccgaggacagtgttatttcaccatacaatataagcacaggctattcagggcttgccactggaaatggactcagtgactcacctgcagggtcaaaggatcatggcagtgtgcccattattgtacctttaattccaccacctttcataaagccaccagcagaagatgatgtgtcaaatgtacaaataatgtgtgcctggtgccagaaagtgggaatcaagcgctattccctgagtatgggaagtgaggtgaaaagcttctgcagcgagaagtgctttgcggcctgccgacgagcctacttcaagagaaataaggctagagatgaagatggacatgctgaaaattttccccagcagcactatgctaaggaaactccaaggcttgccttcaagaataactgcgaactacttagttcatggcacatgagaaagagaaggaaggatctgctcctgtgacctgggccaagatttctagaacccagcttaaa

SEQ ID NO: 4711 - DNA, 628 bp, Artificial Sequence; identical to SEQ ID NO: 3106
  Synthetic polypeptide

SEQ ID NO: 4712 - DNA, 412 bp, Artificial Sequence; identical to SEQ ID NO: 3107
  Synthetic polypeptide

SEQ ID NO: 4713 - DNA, 571 bp, Artificial Sequence; identical to SEQ ID NO: 3108
  Synthetic polypeptide

SEQ ID NO: 4714 - DNA, 4119 bp, Artificial Sequence
  Synthetic polypeptide
atggccggcctccgagggaacgctgtggctggcctcctctggatgctgctgctgtggagtgggggcggcggctgccaggctcagcgggcaggttgcaaaagtgtccactacgatctggtcttcctcctggacacctcctccagcgtgggcaaggaggactttgagaaggtccggcagtgggtggccaacctggtggacaccttcgaggtgggccccgaccgcacccgtgtgggggtcgtgcgctacagcgaccggcccaccacggccttcgagttgggactctttggctcgcaggaggaggtcaaggcggctgcccggcgtctcgcctaccacgggggcaacaccaacacgggagacgcgctccgctacatcacggcccgcagcttctccccacacgccggcggccgccccagggaccgcgcctacaagcaggtggccatcctgctcaccgacggccgcagccaggacctggtgctggacgccgcggcggcagcccaccgcgctggcatccgcatctttgccgtgggcgtgggcgaggcactcaaggaggagctggaggagatcgcctcagagcccaagtccgcccacgtcttccacgtgtccgacttcaatgccatcgacaagatccggggcaagctgcggcgccgtctttgtgaaaatgtgctctgtcctagcgttcgtgtagaaggagatcgctttaagcacaccaatggaggaaccaaggaaatcacaggttttgacctgatggatttgttcagtgtgaaggaaatcttggggaagagagagaatggagctcagagttcctatgtacggatgggatccttccctgtggtgcaaagtactgaggatgtgttcccccaaggtttacctgatgagtacgcctttgtcacaaccttccggttcaggaaaacctctcggaaggaagactggtatatctggcaggtcatcgaccagtacagcatcccacaggtctccatccggctggatggtgaaaacaaggcagtcgagtacaacgctgtgggtgccatgaaagatgctgtcagggtggtcttccgaggttctcgggtcaatgacctctttgaccgggactggcacaagatggccctgagcatccaggcccagaacgtctccctgcacattgactgtgcgctggtgcagacactacccatcgaggaacgggagaacattgacatccagggcaagactgtgattggcaagcgcctctacgacagtgtgcccattgactttgacctacagcggattgtgatctattgtgactcgagacacgcagaattggagacttgttgtgatatcccctcgggtccgtgccaggtgaccgtggtgacagagcctccacctccacccccaccccagcggcctcccaccccaggcagtgaacagattgggtttttgaagaccatcaactgctcctgcccagctggagagaagggtgaaatgggagttgctggccccatggggctccctggtccaaagggagacataggagccattgggccggttggcgctcctggacctaagggagagaaaggtgatgtgggcataggaccttttggccaaggggaaaagggtgaaaagggttccctgggcctgcccggcccccctgggagagacggcagcaaaggcatgagaggggagccaggagagctgggagagccggggctgccgggtgaggtcggcatgcgggggccccaaggaccacctggactccccggacctcctggacgtgtcggagctcctggtctccaaggagaacgaggtgaaaagggaactcgaggagaaaagggagagcgaggcctggatggattccctgggaagcctggggacacaggacagcagggcaggcccggcccttctggtgtggcaggaccccagggagaaaagggtgacgtgggacctgcggggccacctggtgtaccaggctcagtggtgcagcaagagggcttgaaaggggaacagggagctccaggacccagaggtcaccaaggcgcccccggtcctccaggagctcggggtccaataggcccagaaggcagggatggacctcctggtttgcaaggtctccgagggaagaaaggtgacatgggaccacctggaatccctggattgctggggctgcagggccctccaggaccccctggtgtcccaggcccccctggaccgggaggttctccgggtttgcctggagagatcggcttcccgggaaagcctggacctcctgggcccacgggaccccctggaaaggacgggccaaatggaccaccaggtccgccaggaaccaagggagaaccaggagaaagaggggaagatggtctgcctggaaaaccaggccttcggggagaaattggggagcagggcctggcaggccgacctggagagaagggagaagcaggcctcccaggggctccaggcttcccaggtgtgagaggagagaaaggagaccagggagaaaaaggtgaactgggacttccaggactgaaaggtgaccgaggtgaaaagggtgaagctggtcctgcaggccctcccgggttacctggaactacatccctgttcacaccacatccacggatgcccggagaacaagggcccaaaggagagaagggcgatccaggcctgcctggggaaccgggactgcagggccgtcctggagaattggggcctcagggacccactggaccaccgggtgccaagggacaggaaggtgcacatggggctcctggagcagctggaaaccccggtgctcccggacatgtcggtgcccccggtcccagtggccctccaggaagtgtgggtgctcccggcctcagaggcaccccagggaaagatggggagcgtggtgagaagggtgcagcgggggaagaaggcagcccagggccagttggtcccaggggagatcctggtgctcctgggctccctgggccacccggaaaagggaaggatggagagccgggactccgtggatcacctggactccctggacccctaggaaccaaggctgcttgcggaaaagtcagagggtcagaaaactgtgcactgggagggcaatgtgttaagggggatcgaggagctcctgggatccctggttctcctggcagccgtggtgacccaggcattggggttgctggccctcctggcccttccggaccaccaggagacaaaggatccccgggatcacgaggcttacctggattccctggcccccagggcccagccggccgggacggtgcaccaggaaatccaggagaaagagggcctcctggcaagccgggcctctcttcactactgtctccaggggacataaatctcttggctaaggatgtgtgcaatgactgccctcctggccccccaggcctccctggtctaccaggttttaaaggggacaaaggtgtcccaggaaagccagggagagaaggcacagaagggaaaaagggagaggctgggcctccaggcctaccagggcccccaggaatagctggaccacagggaagtcaaggagaacgtggtgcagatggtgaggttgggcagaaaggtgatcagggtcatcctggagttccaggtttcatggggcccccagggaaccctgggccaccaggggcagatggaattgcaggagctgctggaccaccaggaatccaagggtcacctgggaaagaaggccctcctggcccccaaggcccatctggattacccggaatcccaggagaagaaggcaaagagggcagagatggaaagccgggtccccctggagagccgggcaaagcaggagagccaggtctaccaggaccagagggtgcccgaggcccacctggcttcaagggacacacaggcgattctggtgcacccggtccccggggagagtctggtgccatggggcttcctggtcaggaagggttaccaggaaaagatggtgacactggacccactgggccacagggtccccaaggaccaaggggcccaccggtgagttgctgcactgctcccaggactcagttttctcatctgtaaaatggaggcaatctggacggaacaaggaggctgtaagaatccagcaaggtaatccagtgaagtgagacaacagtgcccagcccttggaatgtgccc

SEQ ID NO: 4715 - DNA, 4059 bp, Artificial Sequence
  Synthetic polypeptide
atggccggcctccgagggaacgctgtggctggcctcctctggatgctgctgctgtggagtgggggcggcggctgccaggctcagcgggcaggttgcaaaagtgtccactacgatctggtcttcctcctggacacctcctccagcgtgggcaaggaggactttgagaaggtccggcagtgggtggccaacctggtggacaccttcgaggtgggccccgaccgcacccgtgtgggggtcgtgcgctacagcgaccggcccaccacggccttcgagttgggactctttggctcgcaggaggaggtcaaggcggctgcccggcgtctcgcctaccacgggggcaacaccaacacgggagacgcgctccgctacatcacggcccgcagcttctccccacacgccggcggccgccccagggaccgcgcctacaagcaggtggccatcctgctcaccgacggccgcagccaggacctggtgctggacgccgcggcggcagcccaccgcgctggcatccgcatctttgccgtgggcgtgggcgaggcactcaaggaggagctggaggagatcgcctcagagcccaagtccgcccacgtcttccacgtgtccgacttcaatgccatcgacaagatccggggcaagctgcggcgccgtctttgtgaaaatgtgctctgtcctagcgttcgtgtagaaggagatcgctttaagcacaccaatggaggaaccaaggaaatcacaggttttgacctgatggatttgttcagtgtgaaggaaatcttggggaagagagagaatggagctcagagttcctatgtacggatgggatccttccctgtggtgcaaagtactgaggatgtgttcccccaaggtttacctgatgagtacgcctttgtcacaaccttccggttcaggaaaacctctcggaaggaagactggtatatctggcaggtcatcgaccagtacagcatcccacaggtctccatccggctggatggtgaaaacaaggcagtcgagtacaacgctgtgggtgccatgaaagatgctgtcagggtggtcttccgaggttctcgggtcaatgacctctttgaccgggactggcacaagatggccctgagcatccaggcccagaacgtctccctgcacattgactgtgcgctggtgcagacactacccatcgaggaacgggagaacattgacatccagggcaagactgtgattggcaagcgcctctacgacagtgtgcccattgactttgacctacagcggattgtgatctattgtgactcgagacacgcagaattggagacttgttgtgatatcccctcgggtccgtgccaggtgaccgtggtgacagagcctccacctccacccccaccccagcggcctcccaccccaggcagtgaacagattgggtttttgaagaccatcaactgctcctgcccagctggagagaagggtgaaatgggagttgctggccccatggggctccctggtccaaagggagacataggagccattgggccggttggcgctcctggacctaagggagagaaaggtgatgtgggcataggaccttttggccaaggggaaaagggtgaaaagggttccctgggcctgcccggcccccctgggagagacggcagcaaaggcatgagaggggagccaggagagctgggagagccggggctgccgggtgaggtcggcatgcgggggccccaaggaccacctggactccccggacctcctggacgtgtcggagctcctggtctccaaggagaacgaggtgaaaagggaactcgaggagaaaagggagagcgaggcctggatggattccctgggaagcctggggacacaggacagcagggcaggcccggcccttctggtgtggcaggaccccagggagaaaagggtgacgtgggacctgcggggccacctggtgtaccaggctcagtggtgcagcaagagggcttgaaaggggaacagggagctccaggacccagaggtcaccaaggcgcccccggtcctccaggagctcggggtccaataggcccagaaggcagggatggacctcctggtttgcaaggtctccgagggaagaaaggtgacatgggaccacctggaatccctggattgctggggctgcagggccctccaggaccccctggtgtcccaggcccccctggaccgggaggttctccgggtttgcctggagagatcggcttcccgggaaagcctggacctcctgggcccacgggaccccctggaaaggacgggccaaatggaccaccaggtccgccaggaaccaagggagaaccaggagaaagaggggaagatggtctgcctggaaaaccaggccttcggggagaaattggggagcagggcctggcaggccgacctggagagaagggagaagcaggcctcccaggggctccaggcttcccaggtgtgagaggagagaaaggagaccagggagaaaaaggtgaactgggacttccaggactgaaaggtgaccgaggtgaaaagggtgaagctggtcctgcaggccctcccgggttacctggaactacatccctgttcacaccacatccacggatgcccggagaacaagggcccaaaggagagaagggcgatccaggcctgcctggggaaccgggactgcagggccgtcctggagaattggggcctcagggacccactggaccaccgggtgccaagggacaggaaggtgcacatggggctcctggagcagctggaaaccccggtgctcccggacatgtcggtgcccccggtcccagtggccctccaggaagtgtgggtgctcccggcctcagaggcaccccagggaaagatggggagcgtggtgagaagggtgcagcgggggaagaaggcagcccagggccagttggtcccaggggagatcctggtgctcctgggctccctgggccacccggaaaagggaaggatggagagccgggactccgtggatcacctggactccctggacccctaggaaccaagggggatcgaggagctcctgggatccctggttctcctggcagccgtggtgacccaggcattggggttgctggccctcctggcccttccggaccaccaggagacaaaggatccccgggatcacgaggcttacctggattccctggcccccagggcccagccggccgggacggtgcaccaggaaatccaggagaaagagggcctcctggcaagccgggcctctcttcactactgtctccaggggacataaatctcttggctaaggatgtgtgcaatgactgccctcctggccccccaggcctccctggtctaccaggttttaaaggggacaaaggtgtcccaggaaagccagggagagaaggcacagaagggaaaaagggagaggctgggcctccaggcctaccagggcccccaggaatagctggaccacagggaagtcaaggagaacgtggtgcagatggtgaggttgggcagaaaggtgatcagggtcatcctggagttccaggtttcatggggcccccagggaaccctgggccaccaggggcagatggaattgcaggagctgctggaccaccaggaatccaagggtcacctgggaaagaaggccctcctggcccccaaggcccatctggattacccggaatcccaggagaagaaggcaaagagggcagagatggaaagccgggtccccctggagagccgggcaaagcaggagagccaggtctaccaggaccagagggtgcccgaggcccacctggcttcaagggacacacaggcgattctggtgcacccggtccccggggagagtctggtgccatggggcttcctggtcaggaagggttaccaggaaaagatggtgacactggacccactgggccacagggtccccaaggaccaaggggcccaccggtgagttgctgcactgctcccaggactcagttttctcatctgtaaaatggaggcaatctggacggaacaaggaggctgtaagaatccagcaaggtaatccagtgaagtgagacaacagtgcccagcccttggaatgtgccc

SEQ ID NO: 4716 - DNA, 818 bp, Artificial Sequence
  Synthetic polypeptide
atggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacagaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagagacggaggttgcagtgagccgagatcccaccactgcactccagcctcggtgacaagagcgaaactccgtctcaagaaaa

SEQ ID NO: 4717 - DNA, 602 bp, Artificial Sequence
  Synthetic polypeptide
atggatgaggatgccctcagccgggacgacgttatcggaaaggtctgccttacaagggacaccatagcctctcaccctaagggtttcagcgggtgggcccacctgacagaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagagacggaggttgcagtgagccgagatcccaccactgcactccagcctcggtgacaagagcgaaactccgtctcaagaaaa

SEQ ID NO: 4718 - DNA, 818 bp, Artificial Sequence
  Synthetic polypeptide
atggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagagacggaggttgcagtgagccgagatcccaccactgcactccagcctcggtgacaagagcgaaactccgtctcaagaaaa

SEQ ID NO: 4719 - DNA, 602 bp, Artificial Sequence
  Synthetic polypeptide
atggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagagacggaggttgcagtgagccgagatcccaccactgcactccagcctcggtgacaagagcgaaactccgtctcaagaaaa

SEQ ID NO: 4720 - DNA, 381 bp, Artificial Sequence
  Synthetic polypeptide
cccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagagacggaggttgcagtgagccgagatcccaccactgcactccagcctcggtgacaagagcgaaactccgtctcaagaaaa

SEQ ID NO: 4721 - DNA, 761 bp, Artificial Sequence
  Synthetic polypeptide
atggccaagcgcagctcgctgtacatccgcatcgtggaggggaagaaccttcccgccaaggacatgacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagagacggaggttgcagtgagccgagatcccaccactgcactccagcctcggtgacaagagcgaaactccgtctcaagaaaa

SEQ ID NO: 4722 - DNA, 802 bp, Artificial Sequence; identical to SEQ ID NO: 2212
  Synthetic polypeptide

SEQ ID NO: 4723 - DNA, 2141 bp, Artificial Sequence; identical to SEQ ID NO: 2213
  Synthetic polypeptide

SEQ ID NO: 4724 - DNA, 2192 bp, Artificial Sequence; identical to SEQ ID NO: 2214
  Synthetic polypeptide

SEQ ID NO: 4725 - DNA, 2015 bp, Artificial Sequence; identical to SEQ ID NO: 2215
  Synthetic polypeptide

SEQ ID NO: 4726 - DNA, 2466 bp, Artificial Sequence; identical to SEQ ID NO: 1682
  Synthetic polypeptide

SEQ ID NO: 4727 - DNA, 1806 bp, Artificial Sequence; identical to SEQ ID NO: 1683
  Synthetic polypeptide

SEQ ID NO: 4728 - DNA, 2412 bp, Artificial Sequence; identical to SEQ ID NO: 1684
  Synthetic polypeptide

SEQ ID NO: 4729 - DNA, 2211 bp, Artificial Sequence; identical to SEQ ID NO: 1685
  Synthetic polypeptide

SEQ ID NO: 4730 - DNA, 364 bp, Artificial Sequence; identical to SEQ ID NO: 1686
  Synthetic polypeptide

SEQ ID NO: 4731 - DNA, 303 bp, Artificial Sequence; identical to SEQ ID NO: 148
  Synthetic polypeptide

SEQ ID NO: 4732 - DNA, 301 bp, Artificial Sequence; identical to SEQ ID NO: 147
  Synthetic polypeptide

SEQ ID NO: 4733 - DNA, 2161 bp, Artificial Sequence; identical to SEQ ID NO: 288
  Synthetic polypeptide

SEQ ID NO: 4734 - DNA, 2140 bp, Artificial Sequence; identical to SEQ ID NO: 289
  Synthetic polypeptide

SEQ ID NO: 4735 - DNA, 529 bp, Artificial Sequence; identical to SEQ ID NO: 287
  Synthetic polypeptide

SEQ ID NO: 4736 - DNA, 628 bp, Artificial Sequence; identical to SEQ ID NO: 3115
  Synthetic polypeptide

SEQ ID NO: 4737 - DNA, 412 bp, Artificial Sequence; identical to SEQ ID NO: 3116
  Synthetic polypeptide

SEQ ID NO: 4738 - DNA, 582 bp, Artificial Sequence
  Synthetic polypeptide
atggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccagcctgggcgacaagagcgaaactccatctccgaaaaaagaaa

SEQ ID NO: 4739 - DNA, 546 bp, Artificial Sequence
  Synthetic polypeptide
atggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccagcctgggcgacaagagcgaaactccatctccgaaaaaagaaa

SEQ ID NO: 4740 - DNA, 567 bp, Artificial Sequence
  Synthetic polypeptide
atggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcagccccttctgtgccaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccagcctgggcgacaagagcgaaactccatctccgaaaaaagaaa

SEQ ID NO: 4741 - DNA, 552 bp, Artificial Sequence
  Synthetic polypeptide
atggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccagcctgggcgacaagagcgaaactccatctccgaaaaaagaaa

SEQ ID NO: 4742 - DNA, 597 bp, Artificial Sequence
  Synthetic polypeptide
atggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcagccccttctgtgccaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccagcctgggcgacaagagcgaaactccatctccgaaaaaagaaa

SEQ ID NO: 4743 - DNA, 645 bp, Artificial Sequence
  Synthetic polypeptide
atgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtaacgccacagagacagcaacgagctcagcggctgccaataacatgaggtgggggaaatggggagtgagtgccggtgggcccagggttttcttctcagtgatgaaaatgttttggaaccagatagaggtggtgattggacaacactgtgaaggtactaattgccactgaattattcgctttaaaatggttaatcttatgtatgtgaatttacctcaa

SEQ ID NO: 4744 - DNA, 861 bp, Artificial Sequence
  Synthetic polypeptide
atggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagccgggtatggtggcgcatgcctgtaatctcagcactttgggaggccaaggcaggaggatcacttgagcccaggagttcaagaccagcctgggcaacatagcaagaccccatctctaaaaaaaa

SEQ ID NO: 4745 - DNA, 645 bp, Artificial Sequence
  Synthetic polypeptide
atggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagccgggtatggtggcgcatgcctgtaatctcagcactttgggaggccaaggcaggaggatcacttgagcccaggagttcaagaccagcctgggcaacatagcaagaccccatctctaaaaaaaa

SEQ ID NO: 4746 - DNA, 424 bp, Artificial Sequence
  Synthetic polypeptide
cccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagccgggtatggtggcgcatgcctgtaatctcagcactttgggaggccaaggcaggaggatcacttgagcccaggagttcaagaccagcctgggcaacatagcaagaccccatctctaaaaaaaa

SEQ ID NO: 4747 - DNA, 804 bp, Artificial Sequence
  Synthetic polypeptide
atggccaagcgcagctcgctgtacatccgcatcgtggaggggaagaaccttcccgccaaggacatgacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagccgggtatggtggcgcatgcctgtaatctcagcactttgggaggccaaggcaggaggatcacttgagcccaggagttcaagaccagcctgggcaacatagcaagaccccatctctaaaaaaaa

SEQ ID NO: 4748 - DNA, 3161 bp, Artificial Sequence
  Synthetic polypeptide
atgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggccaagcgcggtggctcccgcctgtaatcccagcactttgggaggcccaggcgggcgggtcacttgaggtcaggagtacgagaccagcctggccaacatggcgaaaccccatctctacgaaaaatacaaaaaaaaaaaaaaaaaaaaa

SEQ ID NO: 4749 - DNA, 3200 bp, Artificial Sequence
  Synthetic polypeptide
atggggtctggtggctctgacagctatcgtatcgccacctcgcaggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggccaagcgcggtggctcccgcctgtaatcccagcactttgggaggcccaggcgggcgggtcacttgaggtcaggagtacgagaccagcctggccaacatggcgaaaccccatctctacgaaaaatacaaaaaaaaaaaaaaaaaaaaa

SEQ ID NO: 4750 - DNA, 3194 bp, Artificial Sequence
  Synthetic polypeptide
atgggaggctgggaggaggagaggaacaggagagccacggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggccaagcgcggtggctcccgcctgtaatcccagcactttgggaggcccaggcgggcgggtcacttgaggtcaggagtacgagaccagcctggccaacatggcgaaaccccatctctacgaaaaatacaaaaaaaaaaaaaaaaaaaaa

SEQ ID NO: 4751 - DNA, 3071 bp, Artificial Sequence
  Synthetic polypeptide
atgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggccaagcgcggtggctcccgcctgtaatcccagcactttgggaggcccaggcgggcgggtcacttgaggtcaggagtacgagaccagcctggccaacatggcgaaaccccatctctacgaaaaatacaaaaaaaaaaaaaaaaaaaaa

SEQ ID NO: 4752 - DNA, 861 bp, Artificial Sequence
  Synthetic polypeptide
atggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacagaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagccgggtatggtggcgcatgcctgtaatctcagcactttgggaggccaaggcaggaggatcacttgagcccaggagttcaagaccagcctgggcaacatagcaagaccccatctctaaaaaaaa

SEQ ID NO: 4753 - DNA, 645 bp, Artificial Sequence
  Synthetic polypeptide
atggatgaggatgccctcagccgggacgacgttatcggaaaggtctgccttacaagggacaccatagcctctcaccctaagggtttcagcgggtgggcccacctgacagaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagccgggtatggtggcgcatgcctgtaatctcagcactttgggaggccaaggcaggaggatcacttgagcccaggagttcaagaccagcctgggcaacatagcaagaccccatctctaaaaaaaa

SEQ ID NO: 4754 - DNA, 1065 bp, Artificial Sequence; identical to SEQ ID NO: 4373
  Synthetic polypeptide

SEQ ID NO: 4755 - DNA, 128 bp, Artificial Sequence; identical to SEQ ID NO: 1082
  Synthetic polypeptide

SEQ ID NO: 4756 - DNA, 546 bp, Artificial Sequence
  Synthetic polypeptide
atgcagaaaagacaaggatattgcagttattgccgtgtgcagtataataacctggaacagactctcactaaaggaaaaactaaaaaggagttcttcaggcagaaggaaaatgattcccgatggaagctcagagatacaggaagtaatgaagaacagtggaaaggtaaatatgtaggcaatcaatctaagtgaatactgtcttgtgggatgaacaacaatggcatataaattgggaggggagtaaatgatgttaatttctaaggactttgcattgtttataaagagaataaaagtaacaagtaattttaggcgttgacagttcagggttgctcattgtaatctcttaccaaaatagactatgaaaagtctgtaactaactacagagttaacagaaaaggaaaaattgaaatgatgaaacgtagtccacaagaagacaagaaaggagaggaaaagggatagttgtataggcaagagtaacagattgaaaaagttaaatacaactctatcagtaatacattaagtgaaaataggtttgatgcttgaatt

SEQ ID NO: 4757 - DNA, 3840 bp, Artificial Sequence
  Synthetic polypeptide
atggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagtcaagccgtctggagctgtgacagccatcttgtgaccatgtggggatgagcacgaggaagaagacaacatgtgaaggaagaaagtcagaaagagcccaatttcttgatggcatcattgagcagctgaacccatgccacagttcctgttaacttaaaaaaataaataaagccatatgtgtttaagccactatcagttgagttttttgttacttgtagctgaaa

SEQ ID NO: 4758 - DNA, 1060 bp, Artificial Sequence
  Synthetic polypeptide
aaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacaggtggcaaattacatcaaggagcagtcgacttgcaacttccaggccatcgtcatctctctcaaggaggagttctacaccaaggccgagagcctcattggagtctatcctgagtcaagccgtctggagctgtgacagccatcttgtgaccatgtggggatgagcacgaggaagaagacaacatgtgaaggaagaaagtcagaaagagcccaatttcttgatggcatcattgagcagctgaacccatgccacagttcctgttaacttaaaaaaataaataaagccatatgtgtttaagccactatcagttgagttttttgttacttgtagctgaaa

SEQ ID NO: 4759 - DNA, 565 bp, Artificial Sequence; identical to SEQ ID NO: 1420
  Synthetic polypeptide

SEQ ID NO: 4760 - DNA, 718 bp, Artificial Sequence; identical to SEQ ID NO: 1366
  Synthetic polypeptide

SEQ ID NO: 4761 - DNA, 353 bp, Artificial Sequence; identical to SEQ ID NO: 2268
  Synthetic polypeptide

SEQ ID NO: 4762 - DNA, 340 bp, Artificial Sequence; identical to SEQ ID NO: 2269
  Synthetic polypeptide

SEQ ID NO: 4763 - DNA, 362 bp, Artificial Sequence; identical to SEQ ID NO: 2270
  Synthetic polypeptide

SEQ ID NO: 4764 - DNA, 2532 bp, Artificial Sequence
  Synthetic polypeptide
atgggggcccggagcggagctcggggcgcgctgctgctggcactgctgctctgctgggacccgaggctgagccaagcaggcactgattctggcagcgaggtgctccctgactccttcccgtcagcgccagcagagccgctgccctacttcctgcaggagccacaggacgcctacattgtgaagaacaagcctgtggagctccgctgccgcgccttccccgccacacagatctacttcaagtgcaacggcgagtgggtcagccagaacgaccacgtcacacaggaaggcctggatgaggccaccggcctgcgggtgcgcgaggtgcagatcgaggtgtcgcggcagcaggtggaggagctctttgggctggaggattactggtgccagtgcgtggcctggagctccgcgggcaccaccaagagtcgccgagcctacgtccgcatcgcctacctgcgcaagaacttcgatcaggagcctctgggcaaggaggtgcccctggaccatgaggttctcctgcagtgccgcccgccggagggggtgcctgtggccgaggtggaatggctcaagaatgaggatgtcatcgaccccacccaggacaccaacttcctgctcaccatcgaccacaacctcatcatccgccaggcccgcctgtcggacactgccaactatacctgcgtggccaagaacatcgtggccaaacgccggagcaccactgccaccgtcatcgtctacgtgaatggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaaataagaaaactctaagcgaccccaacagccacctgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacttcactttccacctgtacaagagggtgcatgtggattaga

SEQ ID NO: 4765 - DNA, 2499 bp, Artificial Sequence
  Synthetic polypeptide
atgggggcccggagcggagctcggggcgcgctgctgctggcactgctgctctgctgggacccgaggctgagccaagcaggcactgattctggcagcgaggtgctccctgactccttcccgtcagcgccagcagagccgctgccctacttcctgcaggagccacaggacgcctacattgtgaagaacaagcctgtggagctccgctgccgcgccttccccgccacacagatctacttcaagtgcaacggcgagtgggtcagccagaacgaccacgtcacacaggaaggcctggatgaggccaccggcctgcgggtgcgcgaggtgcagatcgaggtgtcgcggcagcaggtggaggagctctttgggctggaggattactggtgccagtgcgtggcctggagctccgcgggcaccaccaagagtcgccgagcctacgtccgcatcgcctacctgcgcaagaacttcgatcaggagcctctgggcaaggaggtgcccctggaccatgaggttctcctgcagtgccgcccgccggagggggtgcctgtggccgaggtggaatggctcaagaatgaggatgtcatcgaccccacccaggacaccaacttcctgctcaccatcgaccacaacctcatcatccgccaggcccgcctgtcggacactgccaactatacctgcgtggccaagaacatcgtggccaaacgccggagcaccactgccaccgtcatcgtctacgtgaatggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaatgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacttcactttccacctgtacaagagggtgcatgtggattaga

SEQ ID NO: 4766 - DNA, 1061 bp, Artificial Sequence
  Synthetic polypeptide
atggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaaagagaaaaaatattccgtgatgtgtagcagtgagattgctgtcagtcctaggtaagtgcatatagctgtcagttaagggagttgtttataagcacttggaaagataaatcatgaccatttggcatcagtgtgctaaaaacaagtcttgccaatctaattatattcttccatttgccagcattattcatttatttgccagcttgatgagggaaatgcagtgggcatggtgcatttggacttttgcaaagcatttgacaagatcgttttatgttcccctattggaagaggtggaaagatacagcctaggcaacagaatgtcaccaaaatggggcttgttaaagagtccatgtaaatagggagggagatttcacatggtattctgtgtgtcttagcactaccccactccacatttttatcaatgtttgtaataatatagaacttgtacttatcagattcccagaggatgacatgaagttggaagagataccatcagatgacagagttgggattcaagaagatcccagcagactagaacaatgagccaaacaagatcagaactgagtggggata

SEQ ID NO: 4767 - DNA, 1058 bp, Artificial Sequence
  Synthetic polypeptide
atggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagatgatggatgtctagaaaacacccctgacactgcagagttcagtcgagagttccagttgcaccagcatctctttgatccggaacatgactatccaggcttgggcaagtggaaagagaaaaaatattccgtgatgtgtagcagtgagattgctgtcagtcctaggtaagtgcatatagctgtcagttaagggagttgtttataagcacttggaaagataaatcatgaccatttggcatcagtgtgctaaaaacaagtcttgccaatctaattatattcttccatttgccagcattattcatttatttgccagcttgatgagggaaatgcagtgggcatggtgcatttggacttttgcaaagcatttgacaagatcgttttatgttcccctattggaagaggtggaaagatacagcctaggcaacagaatgtcaccaaaatggggcttgttaaagagtccatgtaaatagggagggagatttcacatggtattctgtgtgtcttagcactaccccactccacatttttatcaatgtttgtaataatatagaacttgtacttatcagattcccagaggatgacatgaagttggaagagataccatcagatgacagagttgggattcaagaagatcccagcagactagaacaatgagccaaacaagatcagaactgagtggggata

SEQ ID NO: 4768 - DNA, 1031 bp, Artificial Sequence
  Synthetic polypeptide
tctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaaagagaaaaaatattccgtgatgtgtagcagtgagattgctgtcagtcctaggtaagtgcatatagctgtcagttaagggagttgtttataagcacttggaaagataaatcatgaccatttggcatcagtgtgctaaaaacaagtcttgccaatctaattatattcttccatttgccagcattattcatttatttgccagcttgatgagggaaatgcagtgggcatggtgcatttggacttttgcaaagcatttgacaagatcgttttatgttcccctattggaagaggtggaaagatacagcctaggcaacagaatgtcaccaaaatggggcttgttaaagagtccatgtaaatagggagggagatttcacatggtattctgtgtgtcttagcactaccccactccacatttttatcaatgtttgtaataatatagaacttgtacttatcagattcccagaggatgacatgaagttggaagagataccatcagatgacagagttgggattcaagaagatcccagcagactagaacaatgagccaaacaagatcagaactgagtggggata

SEQ ID NO: 4769 - DNA, 397 bp, Artificial Sequence; identical to SEQ ID NO: 3335
  Synthetic polypeptide

SEQ ID NO: 4770 - DNA, 289 bp, Artificial Sequence; identical to SEQ ID NO: 3336
  Synthetic polypeptide

SEQ ID NO: 4771 - DNA, 3093 bp, Artificial Sequence; identical to SEQ ID NO: 341
  Synthetic polypeptide

SEQ ID NO: 4772 - DNA, 2979 bp, Artificial Sequence; identical to SEQ ID NO: 342
  Synthetic polypeptide

SEQ ID NO: 4773 - DNA, 3078 bp, Artificial Sequence; identical to SEQ ID NO: 343
  Synthetic polypeptide

SEQ ID NO: 4774 - DNA, 3072 bp, Artificial Sequence; identical to SEQ ID NO: 346
  Synthetic polypeptide

SEQ ID NO: 4775 - DNA, 1935 bp, Artificial Sequence; identical to SEQ ID NO: 347
  Synthetic polypeptide

SEQ ID NO: 4776 - DNA, 1096 bp, Artificial Sequence; identical to SEQ ID NO: 348
  Synthetic polypeptide

SEQ ID NO: 4777 - DNA, 902 bp, Artificial Sequence; identical to SEQ ID NO: 349
  Synthetic polypeptide

SEQ ID NO: 4778 - DNA, 874 bp, Artificial Sequence; identical to SEQ ID NO: 350
  Synthetic polypeptide

SEQ ID NO: 4779 - DNA, 442 bp, Artificial Sequence
  Synthetic polypeptide
atggcgcggctcctctggttgctccggggcctgaccctcggaactgcgcctcggcgggcggtgcggggccaagcgggcggcggcgggcccggcaccgggccgggactgggggaggcagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagaagcttcctgaagtccttgccagaagcagatgccagcaccatgctgcttataaagcctgcagaactgtgagacaaataaatcttgtttctttataaattacccaggctcaggtatctctttatagcaatgcaaacagactaagaca

SEQ ID NO: 4780 - DNA, 324 bp, Artificial Sequence
  Synthetic polypeptide
ggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagaagcttcctgaagtccttgccagaagcagatgccagcaccatgctgcttataaagcctgcagaactgtgagacaaataaatcttgtttctttataaattacccaggctcaggtatctctttatagcaatgcaaacagactaagaca

SEQ ID NO: 4781 - DNA, 572 bp, Artificial Sequence; identical to SEQ ID NO: 159
  Synthetic polypeptide

SEQ ID NO: 4782 - DNA, 624 bp, Artificial Sequence
  Synthetic polypeptide
atggtgtgcgctcgggcggccctcggtcccggcgcgctctgggccgcggcctggggcgtcctgctgctcacagcccctgcgggggcgcagcgtggccggaagaaggtcgtgcacgtgctggagggtgagtcgggctcggtagtggtacagacagcgcctgggcaggtggtaagccaccgtggtggcaccatcgtcttgccctgccgctaccactatgaggcagccgcccacggtcacgacggcgtccggctcaagtggacaaaggtggtggacccgctggccttcaccgacgtcttcgtggcactaggcccccagcaccgggcattcggcagctaccgtgggcgggctgagctgcagggcgacgggcctggggatgcctccctggtcctccgcaacgtcacgctgcaagactacgggcgctatgagtgcgaagtcaccaatgagctggaagatgacgctggcatggtcaagctggacctggaagggacattggcgatgtctggagatattttacgttgtcacatctggagaaggcagttgctactagcccctagtgggtagaggccagggatgcagctatacatcctaccaggcacaggatagtcccccacaaggagtgatcca

SEQ ID NO: 4783 - DNA, 1288 bp, Artificial Sequence; identical to SEQ ID NO: 2642
  Synthetic polypeptide

SEQ ID NO: 4784 - DNA, 625 bp, Artificial Sequence; identical to SEQ ID NO: 2643
  Synthetic polypeptide

SEQ ID NO: 4785 - DNA, 700 bp, Artificial Sequence; identical to SEQ ID NO: 2644
  Synthetic polypeptide

SEQ ID NO: 4786 - DNA, 778 bp, Artificial Sequence; identical to SEQ ID NO: 2645
  Synthetic polypeptide

SEQ ID NO: 4787 - DNA, 238 bp, Artificial Sequence; identical to SEQ ID NO: 2646
  Synthetic polypeptide

SEQ ID NO: 4788 - DNA, 1439 bp, Artificial Sequence
  Synthetic polypeptide
atgcccgccctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaagacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacagaagaccgggagctggccacagtgggact

SEQ ID NO: 4789 - DNA, 3174 bp, Artificial Sequence; identical to SEQ ID NO: 1390
  Synthetic polypeptide

SEQ ID NO: 4790 - DNA, 3024 bp, Artificial Sequence; identical to SEQ ID NO: 1391
  Synthetic polypeptide

SEQ ID NO: 4791 - DNA, 3081 bp, Artificial Sequence; identical to SEQ ID NO: 1392
  Synthetic polypeptide

SEQ ID NO: 4792 - DNA, 2985 bp, Artificial Sequence; identical to SEQ ID NO: 1393
  Synthetic polypeptide

SEQ ID NO: 4793 - DNA, 2775 bp, Artificial Sequence; identical to SEQ ID NO: 1394
  Synthetic polypeptide

SEQ ID NO: 4794 - DNA, 2949 bp, Artificial Sequence; identical to SEQ ID NO: 1395
  Synthetic polypeptide

SEQ ID NO: 4795 - DNA, 1590 bp, Artificial Sequence; identical to SEQ ID NO: 1396
  Synthetic polypeptide

SEQ ID NO: 4796 - DNA, 849 bp, Artificial Sequence; identical to SEQ ID NO: 1397
  Synthetic polypeptide

SEQ ID NO: 4797 - DNA, 2216 bp, Artificial Sequence
  Synthetic polypeptide
atgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccagctggactgtgctgctgccatctcggctcactgcaacctccctgcctgattctcctgactcagcctgtcgagtgcctgcgattgcaggcgcgcggcgccatgcctgactggttttcgtatttttttggtggagacggggtttcgctgtgttggccggactggtctccagctcctaactgcgagtgatccgccagcctcggcctcccgaggtgccgggattgcagacggagtctcgttaactcagtgctcagtggtgcccaggctggagtgcagtggcgtgatctcggctcgctacaacctccacctcccagccgcctgccttggccccccaaagtgccgagattgcagcctctgcccggacgccaccccgtctgggaagtgaggagcgtctctgcctggccgcccatcgtctgggatgtgaggagcccctctgcctggctgcccagtctggaaggtgaggagcgtctctgcccggccgccatcccacctaggaagtgaggagcacctcttcccggccaccatcccatctaggaagtgaggagcgtctctgcccggctgcccatcgtctgagatgtggggagcgcctctgccccgccgccccgtctgggatgtgaggagcgccttggcccggccgtgaccccgtctgggaggtgaggagcgtctctgcccggccaccccgtctgagaagtgaggagaccctccgcccggcaactgccccgtctgagaagtgaggagcccctccgcccggcagccgccccgtctgagaagtgaggagcccctccgcccggctgccaccccgtctgggaagtgaggagcgtctccgcccagcagccaccccgtccgggagggaggtgggggtcagcccccgccaggccagctgccccatccgggagggaggtggggtgtcagccccctgcccggccagccgccccgtccgggaggtgaggggcgcctctgcccggctgcccctactgggaagtgaggagcccctctgcccggccagccgccccgtccgggagggaggtgggggagtcagccccccgcccggccagccgccccttccaggagggaggtggggggttcagcccaccgcccggccagccgccccgtccgggagggaggtgggggggtcagccccccgcccggccagccgccccgtctgggaggtgaggggcgcctctgcccggctgcccctgctgggaagtgaggagcccctctgctgggccaccaccccgtctgggaggtgtacccagcagctcattgagaacgggccatgatgacaatggcggttttgtggaatagaaaggggggaaaggtggggaaaagattgagaaatcggatggttgctgtgtctgtgtagagggaggtagacatgggagacttttcattttgttctgtactaagaaaaattcttctgccttgggatcctgttgatctatgaccttacccccaaccctgtgctctctaaaacatgtgctgtgtccactcagggttaaatggattaagggcggtgcaagatgtgctttgttaaacagatgcttgaaggcagcatgcttgttaagagtcatcaccactccctaatcgcaagtacccagggacacaaacactctgcctaggaaaaccagagacctttgttcacttgtttatctgctgaccttccttccactattgtcctatgaccctgccaaatccccctctgcgagaaacacccaagaatgatcaataaaaaataaaataaaa

SEQ ID NO: 4798 - DNA, 2213 bp, Artificial Sequence
  Synthetic polypeptide
atgggagcagtaagctgtcggcaggggcagcacacccagcagggggaacacacccgggtggctgtccctcacaagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccagctggactgtgctgctgccatctcggctcactgcaacctccctgcctgattctcctgactcagcctgtcgagtgcctgcgattgcaggcgcgcggcgccatgcctgactggttttcgtatttttttggtggagacggggtttcgctgtgttggccggactggtctccagctcctaactgcgagtgatccgccagcctcggcctcccgaggtgccgggattgcagacggagtctcgttaactcagtgctcagtggtgcccaggctggagtgcagtggcgtgatctcggctcgctacaacctccacctcccagccgcctgccttggccccccaaagtgccgagattgcagcctctgcccggacgccaccccgtctgggaagtgaggagcgtctctgcctggccgcccatcgtctgggatgtgaggagcccctctgcctggctgcccagtctggaaggtgaggagcgtctctgcccggccgccatcccacctaggaagtgaggagcacctcttcccggccaccatcccatctaggaagtgaggagcgtctctgcccggctgcccatcgtctgagatgtggggagcgcctctgccccgccgccccgtctgggatgtgaggagcgccttggcccggccgtgaccccgtctgggaggtgaggagcgtctctgcccggccaccccgtctgagaagtgaggagaccctccgcccggcaactgccccgtctgagaagtgaggagcccctccgcccggcagccgccccgtctgagaagtgaggagcccctccgcccggctgccaccccgtctgggaagtgaggagcgtctccgcccagcagccaccccgtccgggagggaggtgggggtcagcccccgccaggccagctgccccatccgggagggaggtggggtgtcagccccctgcccggccagccgccccgtccgggaggtgaggggcgcctctgcccggctgcccctactgggaagtgaggagcccctctgcccggccagccgccccgtccgggagggaggtgggggagtcagccccccgcccggccagccgccccttccaggagggaggtggggggttcagcccaccgcccggccagccgccccgtccgggagggaggtgggggggtcagccccccgcccggccagccgccccgtctgggaggtgaggggcgcctctgcccggctgcccctgctgggaagtgaggagcccctctgctgggccaccaccccgtctgggaggtgtacccagcagctcattgagaacgggccatgatgacaatggcggttttgtggaatagaaaggggggaaaggtggggaaaagattgagaaatcggatggttgctgtgtctgtgtagagggaggtagacatgggagacttttcattttgttctgtactaagaaaaattcttctgccttgggatcctgttgatctatgaccttacccccaaccctgtgctctctaaaacatgtgctgtgtccactcagggttaaatggattaagggcggtgcaagatgtgctttgttaaacagatgcttgaaggcagcatgcttgttaagagtcatcaccactccctaatcgcaagtacccagggacacaaacactctgcctaggaaaaccagagacctttgttcacttgtttatctgctgaccttccttccactattgtcctatgaccctgccaaatccccctctgcgagaaacacccaagaatgatcaataaaaaataaaataaaa

SEQ ID NO: 4799 - DNA, 5394 bp, Artificial Sequence; identical to SEQ ID NO: 3213
  Synthetic polypeptide

SEQ ID NO: 4800 - DNA, 5259 bp, Artificial Sequence; identical to SEQ ID NO: 3214
  Synthetic polypeptide

SEQ ID NO: 4801 - DNA, 5409 bp, Artificial Sequence; identical to SEQ ID NO: 3215
  Synthetic polypeptide

SEQ ID NO: 4802 - DNA, 5403 bp, Artificial Sequence; identical to SEQ ID NO: 3216
  Synthetic polypeptide

SEQ ID NO: 4803 - DNA, 272 bp, Artificial Sequence; identical to SEQ ID NO: 3217
  Synthetic polypeptide

SEQ ID NO: 4804 - DNA, 917 bp, Artificial Sequence; identical to SEQ ID NO: 2352
  Synthetic polypeptide

SEQ ID NO: 4805 - DNA, 1808 bp, Artificial Sequence; identical to SEQ ID NO: 3239
  Synthetic polypeptide

SEQ ID NO: 4806 - DNA, 788 bp, Artificial Sequence; identical to SEQ ID NO: 3240
  Synthetic polypeptide

SEQ ID NO: 4807 - DNA, 1589 bp, Artificial Sequence; identical to SEQ ID NO: 3241
  Synthetic polypeptide

SEQ ID NO: 4808 - DNA, 986 bp, Artificial Sequence; identical to SEQ ID NO: 3242
  Synthetic polypeptide

SEQ ID NO: 4809 - DNA, 389 bp, Artificial Sequence
  Synthetic polypeptide
atgtgcaaaggacttgcagctttgccccactcatgcctggaaagggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggagaa

SEQ ID NO: 4810 - DNA, 449 bp, Artificial Sequence
  Synthetic polypeptide
atgtgcgcaagaaacatttcacaggatattctcatcttacagatgcacagtgctcattggcatatcaatggcaaatatgaggaaaagagtaacctgatgttctgggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggagaa

SEQ ID NO: 4811 - DNA, 65 bp, Artificial Sequence
  Synthetic polypeptide
atggctgagaaggcaaagcaaatttatgaagaattcattcaaacggaggctcctaaagaggagaa

SEQ ID NO: 4812 - DNA, 178 bp, Artificial Sequence
  Synthetic polypeptide
atgtggaatctccttcacgaaaccgactcggctgtggccaccgcgcgccgcccgcgctggctgtgcgctggggcgctggtgctggcgggtggcttctttctcctcggcttcctcttcggttaaaagccaactgcaaggtctaatgactgcaggatctagctatccattgtttctggcc

SEQ ID NO: 4813 - DNA, 2616 bp, Artificial Sequence
  Synthetic polypeptide
atgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatgttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagatgggaccatctagttgcaggaaaacaagctcagggatcccactgattctacattatggtaagttgtataattatttcattatatattaccacataataatagaaataaagtacacaataaatgtaatgggcttgaatcatcctgaaactacctccatcgccatccatggaaaaattgtcctccgcgaaaccagtccctggtgccaaaaaggttgaggactg

SEQ ID NO: 4814 - DNA, 2757 bp, Artificial Sequence
  Synthetic polypeptide
atgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagatgggaccatctagttgcaggaaaacaagctcagggatcccactgattctacattatggtaagttgtataattatttcattatatattaccacataataatagaaataaagtacacaataaatgtaatgggcttgaatcatcctgaaactacctccatcgccatccatggaaaaattgtcctccgcgaaaccagtccctggtgccaaaaaggttgaggactg

SEQ ID NO: 4815 - DNA, 2532 bp, Artificial Sequence
  Synthetic polypeptide
atgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagatgggaccatctagttgcaggaaaacaagctcagggatcccactgattctacattatggtaagttgtataattatttcattatatattaccacataataatagaaataaagtacacaataaatgtaatgggcttgaatcatcctgaaactacctccatcgccatccatggaaaaattgtcctccgcgaaaccagtccctggtgccaaaaaggttgaggactg

SEQ ID NO: 4816 - DNA, 794 bp, Artificial Sequence
  Synthetic polypeptide
atgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcaggtcttggctcagatggcaccatccgcatgaggccttccctgacccctccattaaaattgctgcccatgagcacaggacatggtaaagaaaacaaacaaaaaaatgaaaaataaaagaaagaagaaaaatttctgctcacatccctacctgctgttctcacctgcttcctctcatagcacttacactcctcggacgtgccgcaccatatctgttgatctcgctcactctctgtgtcctccactagaatgtacactccacaaaggcagggattttcatttgttttgctcatcaatccatccccagatgctaggatagcaccttgaatataactgatgctcaatagacagttgttcaataa

SEQ ID NO: 4817 - DNA, 488 bp, Artificial Sequence
  Synthetic polypeptide
atggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcgtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtgacagccttttaaaaactggtgtttggggctggtatcactccagtggattctcagacagctgccagaataactttgttcaagtagaaatc

SEQ ID NO: 4818 - DNA, 1081 bp, Artificial Sequence; identical to SEQ ID NO: 986
  Synthetic polypeptide

SEQ ID NO: 4819 - DNA, 1054 bp, Artificial Sequence; identical to SEQ ID NO: 987
  Synthetic polypeptide

SEQ ID NO: 4820 - DNA, 1334 bp, Artificial Sequence
  Synthetic polypeptide
atggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccagaacccagacctggactcagaggcgctgctagccctgcccctgcctcagctggtgcagaagttacacagtagagagctggcccctgaggccgtgctcttcacctatgtgggaaaggcctgggaagtgaacaaagggaccaactgtgtgacctcctatctggctgactgtgagactcagctgtctcaggccccaaggcagggcctgctctatggcgtccctgtgagcctcaaggagtgcttcacctacaagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcagcaagagtggcctgaagggctgtgtctatggacaggaggcagtgcgtctctccgtgggccccatggcccgggacgtggagagcctggcactgtgcctgcgagccctgctgtgtgaggacatgttccgcttggaccccactgtgcctcccttgcccttcagagaagaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcgacagtaggggtttgaact

SEQ ID NO: 4821 - DNA, 262 bp, Artificial Sequence
  Synthetic polypeptide
atgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaaccagtgtgtctcaccctgtatctctctgccaggctctgtctctcggtctctgtctc

SEQ ID NO: 4822 - DNA, 246 bp, Artificial Sequence
  Synthetic polypeptide
tcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaaccagtgtgtctcaccctgtatctctctgccaggctctgtctctcggtctctgtctc

SEQ ID NO: 4823 - DNA, 205 bp, Artificial Sequence
  Synthetic polypeptide
atgtgggtcccggttgtcttcctcaccctgtccgtgacgtggattgcaccccctctgcaggtgcttgtggcctctcgtggcagggcagtctgcggcggtgttctggtgcacccccagtgggtcctcacagctgcccactgcatcaggaaccagtgtgtctcaccctgtatctctctgccaggctctgtctctcggtctctgtctc

SEQ ID NO: 4824 - DNA, 151 bp, Artificial Sequence
  Synthetic polypeptide
atgtgggtcccggttgtcttcctcaccctggcagtctgcggcggtgttctggtgcacccccagtgggtcctcacagctgcccactgcatcaggaaccagtgtgtctcaccctgtatctctctgccaggctctgtctctcggtctctgtctc

SEQ ID NO: 4825 - DNA, 1063 bp, Artificial Sequence; identical to SEQ ID NO: 2221
  Synthetic polypeptide

SEQ ID NO: 4826 - DNA, 1224 bp, Artificial Sequence
  Synthetic polypeptide
atggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagtcagtcaccaaagggctaatactgtatgattctactacatgaaatgtctaaagtggtcaagttcatagagacagaaagtagaatggtgcttgccagaggctgtggggaggtaggagcgggagttagtgtttactgggttcagagtttctgtttgaaaagttgaaaaagttcaggagttgtgtggtacagatggatggtggtgatagatgtaaagcagtatgagtgtacttaatgccctagtactgtacaccaaaaaatggctgaaatggtaaactttatgtatattttaccacaattttcaaaaa

SEQ ID NO: 4827 - DNA, 1063 bp, Artificial Sequence
  Synthetic polypeptide
atggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagtcagtcaccaaagggctaatactgtatgattctactacatgaaatgtctaaagtggtcaagttcatagagacagaaagtagaatggtgcttgccagaggctgtggggaggtaggagcgggagttagtgtttactgggttcagagtttctgtttgaaaagttgaaaaagttcaggagttgtgtggtacagatggatggtggtgatagatgtaaagcagtatgagtgtacttaatgccctagtactgtacaccaaaaaatggctgaaatggtaaactttatgtatattttaccacaattttcaaaaa

SEQ ID NO: 4828 - DNA, 1179 bp, Artificial Sequence
  Synthetic polypeptide
atggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagtcagtcaccaaagggctaatactgtatgattctactacatgaaatgtctaaagtggtcaagttcatagagacagaaagtagaatggtgcttgccagaggctgtggggaggtaggagcgggagttagtgtttactgggttcagagtttctgtttgaaaagttgaaaaagttcaggagttgtgtggtacagatggatggtggtgatagatgtaaagcagtatgagtgtacttaatgccctagtactgtacaccaaaaaatggctgaaatggtaaactttatgtatattttaccacaattttcaaaaa

SEQ ID NO: 4829 - DNA, 496 bp, Artificial Sequence; identical to SEQ ID NO: 2667
  Synthetic polypeptide

SEQ ID NO: 4830 - DNA, 425 bp, Artificial Sequence
  Synthetic polypeptide
atgcctcgcctgttcttgttccacctgctagaattctgtttactactgaaccaattttccagagcagtcgcggccaaatggaaggacgatgttattaaattatgcggccgcgaattagttcgcgcgcagattgccatttgcggcatgagcacctggagcaaaaggtctctgagccaggaagatgctcctcagacacctagaccagtggcagaaattgtaccatccttcatcaacaaagatacagaaactataattatcatgttggaattcattgctaatttgccaccggagctgaaggcagccctatctgagaggcaaccatcattaccagagctacagcacctaaaagagttaatggtttcctgctactgtcagcccctgggtgccttttcatcccttgaggttaccattgacactactcaaac

SEQ ID NO: 4831 - DNA, 1038 bp, Artificial Sequence
  Synthetic polypeptide
atgacagaacaggagaccctggccctactggaagtgaagaggtctgattccccagagaagagctcaccccaggccttggttcccaatggccggcagccagaaggggaaggtggggccgaatccccgggagctgagtccctcagagtggggtcttcagctggatctcccacagccatagagggggctgaggatggtctagacagcacagtaagtgaggctgccaccttgccctgggggactggccctcagcccagtgctccgttcccggatccccctggctggcgggacattgaaccagagccccctgagtcagaaccacttaccaagctagaggagctgcccgaagacgatgccaacctgctgcctgagaaagcggcccgtgccttcgtgcctattgacctacagtgcattgagcggcagccccaagaagaccttatcgtgcgctgtgaggcaggcgagggcgagtgccgaaccttcatgcccccccgggtcacccaccccgaccccactgagcgcaagtgggctgaggcagtggtgaggccgcctggctgttcctgtgggggctgcgggagctgtggagaccgtgagtggctaagggctgtggcctccgtgggagccgcactcattctcttcccttgcctactatacggggcatatgccttcctgccgtttgatgtcccacggctgcccaccatgagttcccgcctgatctacacactgcgctgcggggtctttgccaccttccccattgtgctggggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccgatgtgtgatcttggaccagtcttacttaacccttggaatcttagtttcttcatctgcaagaggataa

SEQ ID NO: 4832 - DNA, 322 bp, Artificial Sequence
  Synthetic polypeptide
atgacagaacaggagaccctggccctactggaagtgaagagggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccgatgtgtgatcttggaccagtcttacttaacccttggaatcttagtttcttcatctgcaagaggataa

SEQ ID NO: 4833 - DNA, 276 bp, Artificial Sequence; identical to SEQ ID NO: 923
  Synthetic polypeptide

SEQ ID NO: 4834 - DNA, 483 bp, Artificial Sequence; identical to SEQ ID NO: 2246
  Synthetic polypeptide

SEQ ID NO: 4835 - DNA, 914 bp, Artificial Sequence; identical to SEQ ID NO: 931
  Synthetic polypeptide

SEQ ID NO: 4836 - DNA, 251 bp, Artificial Sequence; identical to SEQ ID NO: 932
  Synthetic polypeptide

SEQ ID NO: 4837 - DNA, 1016 bp, Artificial Sequence; identical to SEQ ID NO: 933
  Synthetic polypeptide

SEQ ID NO: 4838 - DNA, 3516 bp, Artificial Sequence; identical to SEQ ID NO: 2247
  Synthetic polypeptide

SEQ ID NO: 4839 - DNA, 3648 bp, Artificial Sequence; identical to SEQ ID NO: 2248
  Synthetic polypeptide

SEQ ID NO: 4840 - DNA, 3555 bp, Artificial Sequence; identical to SEQ ID NO: 2249
  Synthetic polypeptide

SEQ ID NO: 4841 - DNA, 3552 bp, Artificial Sequence; identical to SEQ ID NO: 2250
  Synthetic polypeptide

SEQ ID NO: 4842 - DNA, 3669 bp, Artificial Sequence; identical to SEQ ID NO: 2251
  Synthetic polypeptide

SEQ ID NO: 4843 - DNA, 3687 bp, Artificial Sequence; identical to SEQ ID NO: 2252
  Synthetic polypeptide

SEQ ID NO: 4844 - DNA, 3594 bp, Artificial Sequence; identical to SEQ ID NO: 2253
  Synthetic polypeptide

SEQ ID NO: 4845 - DNA, 3537 bp, Artificial Sequence; identical to SEQ ID NO: 2254
  Synthetic polypeptide

SEQ ID NO: 4846 - DNA, 3558 bp, Artificial Sequence; identical to SEQ ID NO: 2255
  Synthetic polypeptide

SEQ ID NO: 4847 - DNA, 3297 bp, Artificial Sequence; identical to SEQ ID NO: 2256
  Synthetic polypeptide

SEQ ID NO: 4848 - DNA, 3776 bp, Artificial Sequence
  Synthetic polypeptide
atgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatgttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacagggaggaaccaggtggaagtgatgattggatcattggagcggcttccc

SEQ ID NO: 4849 - DNA, 3917 bp, Artificial Sequence
  Synthetic polypeptide
atgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacagggaggaaccaggtggaagtgatgattggatcattggagcggcttccc

SEQ ID NO: 4850 - DNA, 1526 bp, Artificial Sequence
  Synthetic polypeptide
atgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactggatgaatgatgctatgggatttgaattgccctgggtgtattttgtcagtctcgtcatctttgggtcatttttcgtactaaatcttgtacttggtgtattgagcgggcacagtggctcacgcctataatcccagcactttcggaggccgaggcagctggaccacccgagatcaggagtttgagaccagcctgactaaggcagtgaaaccctgtctctactaaaaatacaaaaattagccaggcatggtggcgcatgcctgtaatcccagctacttgggaggctgaggcaggagaatcacttgaaccagggaggtggagattgcagtgagccaagactgcaccattgcattccagcctgggtgacaagagcaaaactccatctcaaaaaaaaaaaaaaaaaaaaaaaaaaaaa

SEQ ID NO: 4851 - DNA, 545 bp, Artificial Sequence
  Synthetic polypeptide
gccaatggcacggaatgtaggagtggctgggttggcccgaacggaggcatcaccaactttgataactttgcctttgccatgcttactgtgtttcagtgcatcaccatggagggctggacagatgtgctctactggatgaatgatgctatgggatttgaattgccctgggtgtattttgtcagtctcgtcatctttgggtcatttttcgtactaaatcttgtacttggtgtattgagcgggcacagtggctcacgcctataatcccagcactttcggaggccgaggcagctggaccacccgagatcaggagtttgagaccagcctgactaaggcagtgaaaccctgtctctactaaaaatacaaaaattagccaggcatggtggcgcatgcctgtaatcccagctacttgggaggctgaggcaggagaatcacttgaaccagggaggtggagattgcagtgagccaagactgcaccattgcattccagcctgggtgacaagagcaaaactccatctcaaaaaaaaaaaaaaaaaaaaaaaaaaaaa

SEQ ID NO: 4852 - DNA, 937 bp, Artificial Sequence
  Synthetic polypeptide
atgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaaggggacagttcacttaatcactcttgcaccagcttccattctgcaaaatggggatattaatgatacctacttcatagacagtgagtattaaaatgaatgtatgtattcaaatggcttagagcaaacagtacctggtacataatacactgtcaataaatgt

SEQ ID NO: 4853 - DNA, 838 bp, Artificial Sequence
  Synthetic polypeptide
atgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaaggggacagttcacttaatcactcttgcaccagcttccattctgcaaaatggggatattaatgatacctacttcatagacagtgagtattaaaatgaatgtatgtattcaaatggcttagagcaaacagtacctggtacataatacactgtcaataaatgt

SEQ ID NO: 4854 - DNA, 3719 bp, Artificial Sequence
  Synthetic polypeptide
atggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaaggacccagggatggagcagtgtcctcactcattgcactcaccctacccaggatctgtaagtaataaatcttggaccttat

SEQ ID NO: 4855 - DNA, 3284 bp, Artificial Sequence
  Synthetic polypeptide
atggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaaggacccagggatggagcagtgtcctcactcattgcactcaccctacccaggatctgtaagtaataaatcttggaccttat

SEQ ID NO: 4856 - DNA, 2657 bp, Artificial Sequence
  Synthetic polypeptide
atgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccagtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaaggacccagggatggagcagtgtcctcactcattgcactcaccctacccaggatctgtaagtaataaatcttggaccttat

SEQ ID NO: 4857 - DNA, 443 bp, Artificial Sequence; identical to SEQ ID NO: 2837
  Synthetic polypeptide

SEQ ID NO: 4858 - DNA, 720 bp, Artificial Sequence
  Synthetic polypeptide
atggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggaggccggtgaggtggctcatgcctgtaatcccaacactttgggaggccgaggagggcagaccacttgaagtcaggagttcaagaccagcctggccaacatggtgaaaccctgctaatgaaaacacaaaaattagctctgcatggtggtgggtgcctgtaatcccagctactagggagaatcgcttgaacacggaaggcggaggttgcactgagccaagatcacgccactgtactccagcctgggtgacagagcaagaccctgtctcaaaaaaataaaaataaa

SEQ ID NO: 4859 - DNA, 1052 bp, Artificial Sequence; identical to SEQ ID NO: 247
  Synthetic polypeptide

SEQ ID NO: 4860 - DNA, 327 bp, Artificial Sequence; identical to SEQ ID NO: 246
  Synthetic polypeptide

SEQ ID NO: 4861 - DNA, 609 bp, Artificial Sequence; identical to SEQ ID NO: 249
  Synthetic polypeptide

SEQ ID NO: 4862 - DNA, 738 bp, Artificial Sequence; identical to SEQ ID NO: 250
  Synthetic polypeptide

SEQ ID NO: 4863 - DNA, 537 bp, Artificial Sequence; identical to SEQ ID NO: 251
  Synthetic polypeptide

SEQ ID NO: 4864 - DNA, 684 bp, Artificial Sequence; identical to SEQ ID NO: 253
  Synthetic polypeptide

SEQ ID NO: 4865 - DNA, 285 bp, Artificial Sequence; identical to SEQ ID NO: 255
  Synthetic polypeptide

SEQ ID NO: 4866 - DNA, 552 bp, Artificial Sequence; identical to SEQ ID NO: 254
  Synthetic polypeptide

SEQ ID NO: 4867 - DNA, 179 bp, Artificial Sequence
  Synthetic polypeptide
atgtgggacctggttctctccatcgccttgtctgtggggtgcactgatgggaggggtggggcccaccctggaagagtggacagtgacacaaggtggacactctctacagatcactgaggataagctggagccacaatgcatgaggcacacacacagcaaggatgacgctgtaaacatag

SEQ ID NO: 4868 - DNA, 2100 bp, Artificial Sequence
  Synthetic polypeptide
atgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttcttatgaatatggatgtgaaactattaacacaacatcacctaactgaatcaagcaccatatgaaaagggtgtatgtaaagaccaagttagatttacgcctacagtgaaaagttggcctaaaatgtaaaaatcacctagtgtaatatactatattaatcaaataaagatcagacacctgattatcacaatacatgcagaaaaaagtattggaaaaatccagtactcattcatgacaaactcccttaacaactctgagtacaatggaacttctgcaagctataaaagggcatatatgaatcactcatgcccagctccatccttagtcatgagtggctgagtgctttcctgtagatcagggacaagggaaggatgtctactttcacacttgaattcaacagtatactgctggtccttgcaagtatgagaacaaaacaaacaaaataaacaaacatgccaatcattcaaggcatccagcataggaaatattaaaatgtattcatttgtagatgacatgaacatctatgtagaaaatctgatagaatcaacaaaaaatatattagaactagtaggtattttagcaagattgcaggacatatgattagtataaacatatcaatcgtctttttatatattactaacaatctgaaaagaaaaacaagaacattgttacatttacaagagcctcaaaaataaataactaggaatagtttcttcttt

SEQ ID NO: 4869 - DNA, 1986 bp, Artificial Sequence
  Synthetic polypeptide
atgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacaggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttcttatgaatatggatgtgaaactattaacacaacatcacctaactgaatcaagcaccatatgaaaagggtgtatgtaaagaccaagttagatttacgcctacagtgaaaagttggcctaaaatgtaaaaatcacctagtgtaatatactatattaatcaaataaagatcagacacctgattatcacaatacatgcagaaaaaagtattggaaaaatccagtactcattcatgacaaactcccttaacaactctgagtacaatggaacttctgcaagctataaaagggcatatatgaatcactcatgcccagctccatccttagtcatgagtggctgagtgctttcctgtagatcagggacaagggaaggatgtctactttcacacttgaattcaacagtatactgctggtccttgcaagtatgagaacaaaacaaacaaaataaacaaacatgccaatcattcaaggcatccagcataggaaatattaaaatgtattcatttgtagatgacatgaacatctatgtagaaaatctgatagaatcaacaaaaaatatattagaactagtaggtattttagcaagattgcaggacatatgattagtataaacatatcaatcgtctttttatatattactaacaatctgaaaagaaaaacaagaacattgttacatttacaagagcctcaaaaataaataactaggaatagtttcttcttt

SEQ ID NO: 4870 - DNA, 1416 bp, Artificial Sequence
  Synthetic polypeptide
atggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagagaaattcttcatgaaatattttctacggctagatcttaattcctataatagtacttggcaacatggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttcttatgaatatggatgtgaaactattaacacaacatcacctaactgaatcaagcaccatatgaaaagggtgtatgtaaagaccaagttagatttacgcctacagtgaaaagttggcctaaaatgtaaaaatcacctagtgtaatatactatattaatcaaataaagatcagacacctgattatcacaatacatgcagaaaaaagtattggaaaaatccagtactcattcatgacaaactcccttaacaactctgagtacaatggaacttctgcaagctataaaagggcatatatgaatcactcatgcccagctccatccttagtcatgagtggctgagtgctttcctgtagatcagggacaagggaaggatgtctactttcacacttgaattcaacagtatactgctggtccttgcaagtatgagaacaaaacaaacaaaataaacaaacatgccaatcattcaaggcatccagcataggaaatattaaaatgtattcatttgtagatgacatgaacatctatgtagaaaatctgatagaatcaacaaaaaatatattagaactagtaggtattttagcaagattgcaggacatatgattagtataaacatatcaatcgtctttttatatattactaacaatctgaaaagaaaaacaagaacattgttacatttacaagagcctcaaaaataaataactaggaatagtttcttcttt

SEQ ID NO: 4871 - DNA, 137 bp, Artificial Sequence; identical to SEQ ID NO: 336
  Synthetic polypeptide

SEQ ID NO: 4872 - DNA, 1230 bp, Artificial Sequence
  Synthetic polypeptide
atggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggttggacccaatgatctgcttttaatgaatagaatatagcagatgtgacagtgtgtgacttctgggactgggtcatagaaggcagcgtggccttctctttgcatcacttattctgggggaagagactgccatgtcatgaagacttgcagccctacagagaagtgtatgggatgaggaaatgaagcctcctgtcaaaagccaattctccagccccagtcaagccttcgtgtaacctcagtcttggtcaacatcttaactgaaacctcatgagagaccctgagccaccagccacccacgtgagctgcttctgaatgcctgatccaccaaaactgtgagataataaatgtttatggagaaatttgttacacagcaataaatagtta

SEQ ID NO: 4873 - DNA, 1233 bp, Artificial Sequence
  Synthetic polypeptide
atggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagctgctcaaccatctccttccacagtgcccaaaactgaagaccagcgtcctcagttagatccttatcagattcttggaccaacaagtagccgccttgcaaatccaggttggacccaatgatctgcttttaatgaatagaatatagcagatgtgacagtgtgtgacttctgggactgggtcatagaaggcagcgtggccttctctttgcatcacttattctgggggaagagactgccatgtcatgaagacttgcagccctacagagaagtgtatgggatgaggaaatgaagcctcctgtcaaaagccaattctccagccccagtcaagccttcgtgtaacctcagtcttggtcaacatcttaactgaaacctcatgagagaccctgagccaccagccacccacgtgagctgcttctgaatgcctgatccaccaaaactgtgagataataaatgtttatggagaaatttgttacacagcaataaatagtta

SEQ ID NO: 4874 - DNA, 1302 bp, Artificial Sequence
  Synthetic polypeptide
atggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggttggacccaatgatctgcttttaatgaatagaatatagcagatgtgacagtgtgtgacttctgggactgggtcatagaaggcagcgtggccttctctttgcatcacttattctgggggaagagactgccatgtcatgaagacttgcagccctacagagaagtgtatgggatgaggaaatgaagcctcctgtcaaaagccaattctccagccccagtcaagccttcgtgtaacctcagtcttggtcaacatcttaactgaaacctcatgagagaccctgagccaccagccacccacgtgagctgcttctgaatgcctgatccaccaaaactgtgagataataaatgtttatggagaaatttgttacacagcaataaatagtta

SEQ ID NO: 4875 - DNA, 954 bp, Artificial Sequence
  Synthetic polypeptide
atggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggttggacccaatgatctgcttttaatgaatagaatatagcagatgtgacagtgtgtgacttctgggactgggtcatagaaggcagcgtggccttctctttgcatcacttattctgggggaagagactgccatgtcatgaagacttgcagccctacagagaagtgtatgggatgaggaaatgaagcctcctgtcaaaagccaattctccagccccagtcaagccttcgtgtaacctcagtcttggtcaacatcttaactgaaacctcatgagagaccctgagccaccagccacccacgtgagctgcttctgaatgcctgatccaccaaaactgtgagataataaatgtttatggagaaatttgttacacagcaataaatagtta

SEQ ID NO: 4876 - DNA, 1251 bp, Artificial Sequence
  Synthetic polypeptide
atgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggttggacccaatgatctgcttttaatgaatagaatatagcagatgtgacagtgtgtgacttctgggactgggtcatagaaggcagcgtggccttctctttgcatcacttattctgggggaagagactgccatgtcatgaagacttgcagccctacagagaagtgtatgggatgaggaaatgaagcctcctgtcaaaagccaattctccagccccagtcaagccttcgtgtaacctcagtcttggtcaacatcttaactgaaacctcatgagagaccctgagccaccagccacccacgtgagctgcttctgaatgcctgatccaccaaaactgtgagataataaatgtttatggagaaatttgttacacagcaataaatagtta

SEQ ID NO: 4877 - DNA, 1254 bp, Artificial Sequence
  Synthetic polypeptide
atgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagctgctcaaccatctccttccacagtgcccaaaactgaagaccagcgtcctcagttagatccttatcagattcttggaccaacaagtagccgccttgcaaatccaggttggacccaatgatctgcttttaatgaatagaatatagcagatgtgacagtgtgtgacttctgggactgggtcatagaaggcagcgtggccttctctttgcatcacttattctgggggaagagactgccatgtcatgaagacttgcagccctacagagaagtgtatgggatgaggaaatgaagcctcctgtcaaaagccaattctccagccccagtcaagccttcgtgtaacctcagtcttggtcaacatcttaactgaaacctcatgagagaccctgagccaccagccacccacgtgagctgcttctgaatgcctgatccaccaaaactgtgagataataaatgtttatggagaaatttgttacacagcaataaatagtta

SEQ ID NO: 4878 - DNA, 1323 bp, Artificial Sequence
  Synthetic polypeptide
atgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggttggacccaatgatctgcttttaatgaatagaatatagcagatgtgacagtgtgtgacttctgggactgggtcatagaaggcagcgtggccttctctttgcatcacttattctgggggaagagactgccatgtcatgaagacttgcagccctacagagaagtgtatgggatgaggaaatgaagcctcctgtcaaaagccaattctccagccccagtcaagccttcgtgtaacctcagtcttggtcaacatcttaactgaaacctcatgagagaccctgagccaccagccacccacgtgagctgcttctgaatgcctgatccaccaaaactgtgagataataaatgtttatggagaaatttgttacacagcaataaatagtta

SEQ ID NO: 4879 - DNA, 1026 bp, Artificial Sequence
  Synthetic polypeptide
atggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggttggacccaatgatctgcttttaatgaatagaatatagcagatgtgacagtgtgtgacttctgggactgggtcatagaaggcagcgtggccttctctttgcatcacttattctgggggaagagactgccatgtcatgaagacttgcagccctacagagaagtgtatgggatgaggaaatgaagcctcctgtcaaaagccaattctccagccccagtcaagccttcgtgtaacctcagtcttggtcaacatcttaactgaaacctcatgagagaccctgagccaccagccacccacgtgagctgcttctgaatgcctgatccaccaaaactgtgagataataaatgtttatggagaaatttgttacacagcaataaatagtta

SEQ ID NO: 4880 - DNA, 8447 bp, Artificial Sequence
  Synthetic polypeptide
atggagaaggatgctgaagatggcgccccttctgagggagcagaggctcctccctctacggaagaggctgcccctccccgttcagaagaggaagaggccccgcgccctccgacagtggaggccccggcagaagatggtttctctccttccgcagaagatgctgtttcttctgtggtggattatcgggatctcattccttctgaagaagggatagttcttccagatgatcatgaagcggatctgaatagagttcgacagaggcttgcaccgcgaccggttcagtcagtgatttcggaagtgctgtccttgccgtcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctctggaagcatttactaatttttttgcgaaagatggttgtaagacactgaaatttttgtaccaagaaggagatgtacctggtattgaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacagatcattatgagagttaaacttgcaagctgtggttttcttgaaaatgttatcttggctcaaaaattttacgttctttacaaactctgtgaagagcaacttactaaacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcaggtcattccccattagaagacttcaccggtgttgccagaagtccgcatgctcctggtgggatccccaacactttcctcccaccgacctacactgcttcattgacaccatctactttggctctaccaggacaagtcccattttgctctttatccctattcgcctcagacaccactagaagctcagtactc

SEQ ID NO: 4881 - DNA, 8411 bp, Artificial Sequence
  Synthetic polypeptide
ggagcagaggctcctccctctacggaagaggctgcccctccccgttcagaagaggaagaggccccgcgccctccgacagtggaggccccggcagaagatggtttctctccttccgcagaagatgctgtttcttctgtggtggattatcgggatctcattccttctgaagaagggatagttcttccagatgatcatgaagcggatctgaatagagttcgacagaggcttgcaccgcgaccggttcagtcagtgatttcggaagtgctgtccttgccgtcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctctggaagcatttactaatttttttgcgaaagatggttgtaagacactgaaatttttgtaccaagaaggagatgtacctggtattgaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacagatcattatgagagttaaacttgcaagctgtggttttcttgaaaatgttatcttggctcaaaaattttacgttctttacaaactctgtgaagagcaacttactaaacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcaggtcattccccattagaagacttcaccggtgttgccagaagtccgcatgctcctggtgggatccccaacactttcctcccaccgacctacactgcttcattgacaccatctactttggctctaccaggacaagtcccattttgctctttatccctattcgcctcagacaccactagaagctcagtactc

SEQ ID NO: 4882 - DNA, 7796 bp, Artificial Sequence
  Synthetic polypeptide
atgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacagatcattatgagagttaaacttgcaagctgtggttttcttgaaaatgttatcttggctcaaaaattttacgttctttacaaactctgtgaagagcaacttactaaacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcaggtcattccccattagaagacttcaccggtgttgccagaagtccgcatgctcctggtgggatccccaacactttcctcccaccgacctacactgcttcattgacaccatctactttggctctaccaggacaagtcccattttgctctttatccctattcgcctcagacaccactagaagctcagtactc

SEQ ID NO: 4883 - DNA, 7688 bp, Artificial Sequence
  Synthetic polypeptide
atgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcaggtcattccccattagaagacttcaccggtgttgccagaagtccgcatgctcctggtgggatccccaacactttcctcccaccgacctacactgcttcattgacaccatctactttggctctaccaggacaagtcccattttgctctttatccctattcgcctcagacaccactagaagctcagtactc

SEQ ID NO: 4884 - DNA, 232 bp, Artificial Sequence; identical to SEQ ID NO: 1243
  Synthetic polypeptide

SEQ ID NO: 4885 - DNA, 1497 bp, Artificial Sequence; identical to SEQ ID NO: 4488
  Synthetic polypeptide

SEQ ID NO: 4886 - DNA, 897 bp, Artificial Sequence; identical to SEQ ID NO: 2579
  Synthetic polypeptide

SEQ ID NO: 4887 - DNA, 2240 bp, Artificial Sequence
  Synthetic polypeptide
atgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagaaaaagtctcaattttggaaaagaaaggctgcctggagaaagatttgaagtataaaattataatagcaagtaattcaaaataacctaatgcctaagagaagagaaattactaaaaaatttgatattcaccaatttgaacattttataatcctaacaatggattattagaaatacaacataatagaagatacttagaataaaatatgaagtaagcaaaaaggttgtaaaattgtaaatataatttgattaatttttatttaacaaataca

SEQ ID NO: 4888 - DNA, 1316 bp, Artificial Sequence
  Synthetic polypeptide
atgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagaaaaagtctcaattttggaaaagaaaggctgcctggagaaagatttgaagtataaaattataatagcaagtaattcaaaataacctaatgcctaagagaagagaaattactaaaaaatttgatattcaccaatttgaacattttataatcctaacaatggattattagaaatacaacataatagaagatacttagaataaaatatgaagtaagcaaaaaggttgtaaaattgtaaatataatttgattaatttttatttaacaaataca

SEQ ID NO: 4889 - DNA, 2195 bp, Artificial Sequence
  Synthetic polypeptide
atgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagaaaaagtctcaattttggaaaagaaaggctgcctggagaaagatttgaagtataaaattataatagcaagtaattcaaaataacctaatgcctaagagaagagaaattactaaaaaatttgatattcaccaatttgaacattttataatcctaacaatggattattagaaatacaacataatagaagatacttagaataaaatatgaagtaagcaaaaaggttgtaaaattgtaaatataatttgattaatttttatttaacaaataca

SEQ ID NO: 4890 - DNA, 436 bp, Artificial Sequence; identical to SEQ ID NO: 1262
  Synthetic polypeptide

SEQ ID NO: 4891 - DNA, 858 bp, Artificial Sequence
  Synthetic polypeptide
atggcgctgcggcgcctcctgctgctgctgctgctctcgctggagtccctggacctgctgcccagcgtccacggagcccgcggccgcgccgccaaccggaccctgagtgcaggcggcgctgccgtcgggggccggagggccgggggcgccctggcacggggcggccgcgagctgaacggcaccgcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctgcggggtgatcgccttcgtcatcgtggccggcgtcttcgccaaggtctcctacgacaaggcccaccgccctccacgggagatgaacatccacagggctctggctgacatcttaagacaacagggaccaatccccatagcacactgtgaaagagaaactatctcggctatcgatacctctcccaaagagaacacgccggtcagatcgtcctccaaaaaccactacactcctgtgcgtacggccaagcagactccaggaccaagaacatcacttggaaaatcctagttgctcaagagctgtttgttcagggaatga

SEQ ID NO: 4892 - DNA, 340 bp, Artificial Sequence
  Synthetic polypeptide
gaccaacttcaccgtctacatcacctgcggggtgatcgccttcgtcatcgtggccggcgtcttcgccaaggtctcctacgacaaggcccaccgccctccacgggagatgaacatccacagggctctggctgacatcttaagacaacagggaccaatccccatagcacactgtgaaagagaaactatctcggctatcgatacctctcccaaagagaacacgccggtcagatcgtcctccaaaaaccactacactcctgtgcgtacggccaagcagactccaggaccaagaacatcacttggaaaatcctagttgctcaagagctgtttgttcagggaatga

SEQ ID NO: 4893 - DNA, 1428 bp, Artificial Sequence
  Synthetic polypeptide
atgctcactcgagtgaaatctgccgtggccaatttcatgggcggcatcatggctggcagctcaggctccgagcacggcggcggcagctgcggaggctcggacctgcccctgcgtttcccctacgggcggccagagttcctggggctgtctcaggacgaggtggagtgcagcgccgaccacatcgcccgccccatcctcatcctcaaggagactcggcggctgccctgggccactggctacgcagaggttatcaatgccgggaagagcacacacaatgaagaccaagccagctgtgaggtgctcactgtgaagaagaaggcaggggccgtgacctcaaccccaaacaggaactcatccaagagacggtcctcccttcccaatggggaagggctgcagctgaaggagaactcggaatccgagggtgtttcctgccactattggtcgctgtttgacgggcacgcggggtccggggccgcggtggtggcgtcacgcctgctgcagcaccacatcacggagcagctgcaggacatcgtggacatcctgaagaactccgccgtcctgccccctacctgcctgggggaggagcctgagaacacgcccgccaacagccggactctgacccgggcagcctccctgcgcggaggggtgggggccccgggctcccccagcacgccccccacacgcttctttaccgagaagaagattccccatgagtgcctggtcatcggagcgcttgaaagtgcattcaaggaaatggacctacagatagaacgagagaggagttcatataatatatctggtggctgcacggccctcattgtgatttgccttttggggaagctgtatgttgcaaatgctggggatagcagggccataatcatcagaaatggagaaattatccccatgtcttcagaatttacccccgagacggagcgccagcgacttcagtacctggcattcatgcagcctcacttgctgggaaatgagttcacacatttggagtttccaaggagagtacagagaaaggagcttggaaagaagatgctctacagggactttaatatgacaggctgggcatacaaaaccattgaggatgaggacttgaagttcccccttatatatggagaaggcaagaaggcccgggtaatggcaactattggagtgaccaggggacttggggaccatgacctgaaggtgcatgactccaacatctacattaaaccattcctgtcttcagctccagaggtaagaatctacgatctttcaaaatatgatcatggatcagatgatgtgctgatcttggccactgatggactctgggacgttttatcaaatgaagaagtagcagaagcaatcactcagtttcttcctaactgtgatccagatgatcctcacaggtgattctgatgctgctaaaattcaagaacc

SEQ ID NO: 4894 - DNA, 770 bp, Artificial Sequence; identical to SEQ ID NO: 3389
  Synthetic polypeptide

SEQ ID NO: 4895 - DNA, 867 bp, Artificial Sequence
  Synthetic polypeptide
atgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgttttccttcttttgagaaaactgaagccatggtattctgaggactagagatgactcaacacagctggtgaatctcctcatatgcaatccactgggcttgatctgcttcagattgctgatgcactgctgctaaagctatacatttaaaaccctcactaaaggatcagggaccatcatggaagaggaggaaacatgaaattgtaagagccagattcggggggtagagtgtggaggtcag

SEQ ID NO: 4896 - DNA, 738 bp, Artificial Sequence
  Synthetic polypeptide
atgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgttttccttcttttgagaaaactgaagccatggtattctgaggactagagatgactcaacacagctggtgaatctcctcatatgcaatccactgggcttgatctgcttcagattgctgatgcactgctgctaaagctatacatttaaaaccctcactaaaggatcagggaccatcatggaagaggaggaaacatgaaattgtaagagccagattcggggggtagagtgtggaggtcag

SEQ ID NO: 4897 - DNA, 869 bp, Artificial Sequence
  Synthetic polypeptide
tcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtgtacgcctgggccagatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgttttccttcttttgagaaaactgaagccatggtattctgaggactagagatgactcaacacagctggtgaatctcctcatatgcaatccactgggcttgatctgcttcagattgctgatgcactgctgctaaagctatacatttaaaaccctcactaaaggatcagggaccatcatggaagaggaggaaacatgaaattgtaagagccagattcggggggtagagtgtggaggtcag

SEQ ID NO: 4898 - DNA, 392 bp, Artificial Sequence; identical to SEQ ID NO: 410
  Synthetic polypeptide

SEQ ID NO: 4899 - DNA, 775 bp, Artificial Sequence; identical to SEQ ID NO: 215
  Synthetic polypeptide

SEQ ID NO: 4900 - DNA, 980 bp, Artificial Sequence; identical to SEQ ID NO: 139
  Synthetic polypeptide

SEQ ID NO: 4901 - DNA, 1256 bp, Artificial Sequence; identical to SEQ ID NO: 140
  Synthetic polypeptide

SEQ ID NO: 4902 - DNA, 1277 bp, Artificial Sequence; identical to SEQ ID NO: 142
  Synthetic polypeptide

SEQ ID NO: 4903 - DNA, 427 bp, Artificial Sequence
  Synthetic polypeptide
atgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtatcattagactggcaaaggatcatccgtggcaccaaaagccttaagaacc

SEQ ID NO: 4904 - DNA, 292 bp, Artificial Sequence
  Synthetic polypeptide
atggaacgttgggccatgcgtgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtatcattagactggcaaaggatcatccgtggcaccaaaagccttaagaacc

SEQ ID NO: 4905 - DNA, 393 bp, Artificial Sequence
  Synthetic polypeptide
gaaatccagctagtcctgtctgtcataacctcctgggctcctgtttgcctctctccctccagctcctttgctcttggtggcctctgattggggccaacactacaagcaaggtcaagcgcagtgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtatcattagactggcaaaggatcatccgtggcaccaaaagccttaagaacc

SEQ ID NO: 4906 - DNA, 500 bp, Artificial Sequence; identical to SEQ ID NO: 204
  Synthetic polypeptide

SEQ ID NO: 4907 - DNA, 656 bp, Artificial Sequence; identical to SEQ ID NO: 205
  Synthetic polypeptide

SEQ ID NO: 4908 - DNA, 524 bp, Artificial Sequence; identical to SEQ ID NO: 207
  Synthetic polypeptide

SEQ ID NO: 4909 - DNA, 878 bp, Artificial Sequence
  Synthetic polypeptide
atggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgaatctcttcttcacaccgcacttgcagagactgtattgatacagacgccagagcacatcagcccttgcacaacacagtccagtggctccatgtcgccccgtgtgaaatcc

SEQ ID NO: 4910 - DNA, 3371 bp, Artificial Sequence; identical to SEQ ID NO: 1268
  Synthetic polypeptide

SEQ ID NO: 4911 - DNA, 3206 bp, Artificial Sequence; identical to SEQ ID NO: 1269
  Synthetic polypeptide

SEQ ID NO: 4912 - DNA, 5018 bp, Artificial Sequence
  Synthetic polypeptide
atggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctgggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccaacccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggctggagatccaagcccaacttggccactcaccagatggtttgtaacttgggcagattatcgagcagggtttaattctcctcgtttgtggaa

SEQ ID NO: 4913 - DNA, 5270 bp, Artificial Sequence
  Synthetic polypeptide
atgagccgtggcttttggctggcggagccgctggcagggaccgggccccaccctgccccagtggctgccgactcacgcgggtgcagctctgttccgcggaggcacgccccctcccgtctctccgtctcgaccccctcgcggggcccaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctggtgaggggcagtgtggggaggaagggaaagcaggagaagggctgggtcggctcagggactcacaggacactgtggcaggagcctctgatctcatcaggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccaacccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggctggagatccaagcccaacttggccactcaccagatggtttgtaacttgggcagattatcgagcagggtttaattctcctcgtttgtggaa

SEQ ID NO: 4914 - DNA, 592 bp, Artificial Sequence
  Synthetic polypeptide
atgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggagcagtggctcacgcctgtaatcccagctctttgggaggccgaagcgggtagatcaccagaggtcaggagttcgagaccagcctggccaacatggtgaaaccccgtctctgctaaaaatacaaaaaattagccgggtgtggtggcgcacacctgtaatcccaactacttgggaggctgaggcaggagaatcacttgaactcgggaggtggaggttgcagtgagccgagatcgcaccattgcactgggcaacaagagtgaaactccatctcaaaaaaagaaaacaa

SEQ ID NO: 4915 - DNA, 802 bp, Artificial Sequence
  Synthetic polypeptide
atgggcggcctcttctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggagcagtggctcacgcctgtaatcccagctctttgggaggccgaagcgggtagatcaccagaggtcaggagttcgagaccagcctggccaacatggtgaaaccccgtctctgctaaaaatacaaaaaattagccgggtgtggtggcgcacacctgtaatcccaactacttgggaggctgaggcaggagaatcacttgaactcgggaggtggaggttgcagtgagccgagatcgcaccattgcactgggcaacaagagtgaaactccatctcaaaaaaagaaaacaa

SEQ ID NO: 4916 - DNA, 826 bp, Artificial Sequence
  Synthetic polypeptide
atgggcggcctcttctggcgctccgcgctgcgggggctgcgctgcggcccgcgggccccgggcccgagcctgctagtgcgccacggctcggggctccctccatcggctctgaaaagagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggagcagtggctcacgcctgtaatcccagctctttgggaggccgaagcgggtagatcaccagaggtcaggagttcgagaccagcctggccaacatggtgaaaccccgtctctgctaaaaatacaaaaaattagccgggtgtggtggcgcacacctgtaatcccaactacttgggaggctgaggcaggagaatcacttgaactcgggaggtggaggttgcagtgagccgagatcgcaccattgcactgggcaacaagagtgaaactccatctcaaaaaaagaaaacaa

SEQ ID NO: 4917 - DNA, 797 bp, Artificial Sequence
  Synthetic polypeptide
atggagcccaaagaagccactgggaaagaaaacatggtcaccaagaaaaagaatctggccttcttgaggtctagactctatatgctggagagaaggaagactgacactgtggttgagagcagtgtttctggggaccactctggcaccttgaggaggagccaatctgacaggactgaatacaaccagaaattacaagaaaagatgactccacagggtgagtgttctgtagctgagaccttaaccccagaggaagagcatcatatgaagaggatgatggcaaagcgggaaaagatcattaaggagctgatacagacagaaaaggattatctcaatgatctagagctgtgtgttagggaagtggttcagcccctgagaaataaaaagactgataggctggatgtggatagcttgtttagcaacattgagtccgtgcatcagatatcagccaagctgctgtcattgttggaagaggccacaacagacgtggaaccggccatgcaagtaattggagaagtattcttgcagattaaagggccactggaagatatttataaaatctactgctatcaccatgatgaagcacatagtatactggagtcctatgaaaaggaagaagagctgaaggaacatttgagccactgtatccagtccttaaagaaaatatacatgcaagagaatagaagaaactactgaaggatgtactctatcaaaatgaggaagaaccaacacaggaaagaggcaaagagaatctccaggatgatgggaggggaattcctacaagacggctgcacatctgg

SEQ ID NO: 4918 - DNA, 791 bp, Artificial Sequence
  Synthetic polypeptide
atggagcccaaagaagccactgggaaagaaaacatggtcaccaagaaaaagaatctggccttcttgaggtctagactctatatgctggagagaaggaagactgacactgtggttgagagcagtgtttctggggaccactctggcaccttgaggaggagccaatctgacaggactgaatacaaccagaaattacaagaaaagatgactccacagggtgagtgttctgtagctgagaccttaaccccagaggaagagcatcatatgaagaggatgatggcaaagcgggaaaagatcattaaggagctgatacagacagaaaaggattatctcaatgatctagagctgtgtgttagggaagtggttcagcccctgagaaataaaaagactgataggctggatgtggatagcttgtttagcaacattgagtccgtgcatcagatatcagccaagctgctgtcattgttggaagaggccacaacagacgtggaaccggccatgcaagtaattggagaagtattcttgcagattaaagggccactggaagatatttataaaatctactgctatcaccatgatgaagcacatagtatactggagtcctatgaaaaggaagaagagctgaaggaacatttgagccactgtatccagtccttaaagaaaatatacatgcaagaaagaaactactgaaggatgtactctatcaaaatgaggaagaaccaacacaggaaagaggcaaagagaatctccaggatgatgggaggggaattcctacaagacggctgcacatctgg

SEQ ID NO: 4919 - DNA, 397 bp, Artificial Sequence
  Synthetic polypeptide
atgaaaagaaatacctgtgatttgctttctcggagcaaaagttttctctttctccaatcactcactctggaggcagctagctgtcaactcacaaagacactcaagcagcctatggaagaaggccacatggtaaaatatggaggcctccagccaacagtcagcaaggaactgagacaagtcaacaaccatgtgagtgactcgagaagtgcttctctagctccagttgagacttgcagtagcagcagcctcagctggcggcttgactgcaatctcttgagagaccctaagctctcctgaattcttgatccttagaaactgtgtgaggtaagagatatttgttgctttaagatgctacatttggggataattcattacacagaaatagatatctcattca

SEQ ID NO: 4920 - DNA, 842 bp, Artificial Sequence
  Synthetic polypeptide
atgaaaaatgccacgattgtaatgtctgtgaggagagagcaaggcagttcttcaggggaggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccagatctgcattaccgttggaaaacagcagcctcagaaccacagtagccatgaagaccatcagccttcaaccaccacccttgtatcagaggagacaaataagcttggaaatcctcaaaaagcctcatcctcagagcaatgtcattatatatcttgtcttacagctccatgatgtggttccattctttgtcctaactcattctctcacctgactcaaagctcactttgaaggaaaagtgcgatactagggcactggtcaaaaacgatcagcttcaattgtttaactttgtagtagcctaagcctgcagtaccgttagggagcaaacaagagctctgaaaaattgttaaacggacatctgaagaacaagatgttaatagggaactcttaaatactctgacatattcctgaggatctagaaggcccaacacatacacagggatgtgtgcatgcccatgagatacctgagggtaccagtagttcacttctagctgatcttgaagcccttgagaagaaggaagagaaggctaaagtagacttacaaactgcttgagcattgaagtag

SEQ ID NO: 4921 - DNA, 77 bp, Artificial Sequence; identical to SEQ ID NO: 1778
  Synthetic polypeptide

SEQ ID NO: 4922 - DNA, 280 bp, Artificial Sequence
  Synthetic polypeptide
atggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagttacatgtctggatactggctactggctactgtattggtcagcacag

SEQ ID NO: 4923 - DNA, 160 bp, Artificial Sequence
  Synthetic polypeptide
atgcttcaagatttaagtgcaagtgtcttctttccaccttgttcacaacacagaacgttagctcaggtacctgacaatgatgagcagtttgtaccagactatcaggctgaaagttacatgtctggatactggctactggctactgtattggtcagcacag

SEQ ID NO: 4924 - DNA, 322 bp, Artificial Sequence
  Synthetic polypeptide
atgagtggaagaggagatggagggcagcagcagctgctgcactcaaagtttttggctgggtttgtctgccacattgaaaagaatgaaagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagttacatgtctggatactggctactggctactgtattggtcagcacag

SEQ ID NO: 4925 - DNA, 2905 bp, Artificial Sequence
  Synthetic polypeptide
atgatgagcttcggcggcgcggacgcgctgctgggcgccccgttcgcgccgctgcatggcggcggcagcctccactacgcgctagcccgaaagggtggcgcaggcgggacgcgctccgccgctggctcctccagcggcttccactcgtggacacggacgtccgtgagctccgtgtccgcctcgcccagccgcttccgtggcgcaggcgccgcctcaagcaccgactcgctggacacgctgagcaacgggccggagggctgcatggtggcggtggccacctcacgcagtgagaaggagcagctgcaggcgctgaacgaccgcttcgccgggtacatcgacaaggtgcggcagctggaggcgcacaaccgcagcctggagggcgaggctgcggcgctgcggcagcagcaggcgggccgctccgctatgggcgagctgtacgagcgcgaggtccgcgagatgcgcggcgcggtgctgcgcctgggcgcggcgcgcggtcagctacgcctggagcaggagcacctgctcgaggacatcgcgcacgtgcgccagcgcctagacgacgaggcccggcagcgagaggaggccgaggcggcggcccgcgcgctggcgcgcttcgcgcaggaggccgaggcggcgcgcgtggacctgcagaagaaggcgcaggcgctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggaagccattcagcagctggacgctgagctgaggaacaccaagtgggagatggccgcccagctgcgagaataccaggacctgctcaatgtcaagatggctctggatatagagatagccgcttacagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggccaagtccccagagaaggaagaggccaagtcccctgagaaggccaagtccccagtgaaggcagaagcaaagtcccctgagaaggccaagtccccagtgaaggcagaagcaaagtcccctgagaaggccaagtccccagtgaaggaagaagcaaagtcccctgagaaggccaagtccccagtgaaggaagaagcaaagtcccctgagaaggccaagtccccagtgaaggaagaagcaaagacccccgagaaggccaagtccccagtgaaggaagaagctaagtccccagagaaggccaagtccccagagaaggccaagactcttgatgtgaagtctccagaagccaagactccagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggaggccaagacgggagggtcacttgaacctggtaaggtggaggttgcagtgagctgagatcatgccactgtactccagcctacgcaacaaagcaagactccgtctcaaaataaataaataaaaa

SEQ ID NO: 4926 - DNA, 454 bp, Artificial Sequence
  Synthetic polypeptide
atggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggctggagcaagaagaggacctgtgcagggcagagcaggaggccccccgagggaaaatgacatttgaagacaaagtcagacatctacaagccaaggaatgccagagattgccagcaaaccaccaaaaactaaggaaagggatggaacatatactttcttgtagccctcagaaggaaccaactatgccaacactttgatctcagacttctggcttccacaactgtaacaataaatttatgtcgtttaagccaccccatttgtggtatgttgttaccagagccctcatgactaataca

SEQ ID NO: 4927 - DNA, 489 bp, Artificial Sequence
  Synthetic polypeptide
atggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgagggaaaatgacatttgaagacaaagtcagacatctacaagccaaggaatgccagagattgccagcaaaccaccaaaaactaaggaaagggatggaacatatactttcttgtagccctcagaaggaaccaactatgccaacactttgatctcagacttctggcttccacaactgtaacaataaatttatgtcgtttaagccaccccatttgtggtatgttgttaccagagccctcatgactaataca

SEQ ID NO: 4928 - DNA, 558 bp, Artificial Sequence; identical to SEQ ID NO: 2797
  Synthetic polypeptide

SEQ ID NO: 4929 - DNA, 697 bp, Artificial Sequence
  Synthetic polypeptide
atgcgcccattggctggtggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggtgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaaggatggctgagagcatgaacagacatggtgaatgcaaaacactcaaaacaggctggacaccaaatcaacactgcacaaat

SEQ ID NO: 4930 - DNA, 553 bp, Artificial Sequence
  Synthetic polypeptide
atgcgcccattggctggtgctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggtgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaaggatggctgagagcatgaacagacatggtgaatgcaaaacactcaaaacaggctggacaccaaatcaacactgcacaaat

SEQ ID NO: 4931 - DNA, 814 bp, Artificial Sequence
  Synthetic polypeptide
atgcgcccattggctggtggttcacgttgggcatgctggctcacaaggtgcttgattagctgctttgacataaacgttcaaggacgtttgttggttaagttaagacctaaaccaacagcaaatacaacttgccctggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggtgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaaggatggctgagagcatgaacagacatggtgaatgcaaaacactcaaaacaggctggacaccaaatcaacactgcacaaat

SEQ ID NO: 4932 - DNA, 766 bp, Artificial Sequence
  Synthetic polypeptide
atgaaaagccacaggggggatggggagggccaagggccagggccgccaccaagtcgttcacagcagctgcttggtgtcctctctgcaggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggtgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaaggatggctgagagcatgaacagacatggtgaatgcaaaacactcaaaacaggctggacaccaaatcaacactgcacaaat

SEQ ID NO: 4933 - DNA, 225 bp, Artificial Sequence
  Synthetic polypeptide
atgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggagatggggtcttataaaaacagacagcacacactgcggtgaggcttcactga

SEQ ID NO: 4934 - DNA, 3611 bp, Artificial Sequence
  Synthetic polypeptide
atgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagccatcaccgatgattcctccaggtactgtaaaatctgaggcaactagcgattggagtcgaccccccagcacaacacagcagccctgcagaaaagtggctagactgtttaaaaaaaaaaaaaagaaaagaaaaaaaaggacaagctccactcaaaggtcaccaacctcaaagattgaaggcagataagcccacaaagatgagaaaggatcagtacaagaacattgaaaactcaaaatgccacagtgccctctttcctccaaatgactgcatcacttctccagcaaggtttcggaaccgggttgaggctgagatgcctgaaatgacagaagtagaattcataatatggatagggacaaagtttactgaggtaaaggagcgtgttgtaacccaattctaggaagctaaaaatcatgttaaaacattgcaggaactgacagtaaaatgagccagtttagagaagaatagagctgaaaaatactacaaatgctgtcacaagtattgatagcagtatagaccaagtgaaggaaagaatcttagagttgaagactgtctttctgaaataatacaggcagacaagaatagagaaaaaggaatgaacaaaaccaccaagaaatatgtgattatgtgaagagactgaatctatgactgattggtgtacttgaaagagataggaagaatggaaccagcttggaaaacatattccaggatataatccatgagaactttcccaacatagctagataggccaacattcaaattcaggaaatgcagagaacctcagtaagatactacttgagaagatcatccccaagacacatactcatcagattctccaaggacaaaatgagagaaaaaatgttaaaggcagctagagggaaaggccaggttacctacaaagggaagcccatcagcctaacagtggacctctcagctgaaaccctgcaagccagaagagattggaggccaatgttcaacattcttagaaaaaagaaattccaatccagaatttcatatccgaccacattaagctttatacgtgaaggagaaataagattctttcaagacaagcaaatgctgagggaatttgttaccaccagacctgtcttaacaagagttattgagagaagtactaaatatggacaggaaagactatcaccatccacgacaaaaacacactgaagtacacagaccagtgatactataaagcaatcacataagtctgcagaataaccagctaacatcatgatgacaggatcaaatccacacatttcaattctaatcttatatgtaaatggtctaaatacaccaattaaaatacatagagtggcaagctggataaagaaccaggacctattggtatcctgtcttcaagagacccttctcatatgcaatgacacacataagtcaaaataaatagatgaaggaaagtctaccaagcaaatagaaaacagaaaaatgcaggagttgcaattctagtttctgacaaaacagactttaaaccaacaaagataaaaaaaaagacaaagaagggcatcacgtaacggtaaaggattcaattcaacaagaagagcttactgtcctaaatatatatgcacataacacaggagcacccagattcataaggcaagttcttagagaccttcaaagagacttagactcccacacaataatagtggtagactttaacagcctattgaaaatattaattaattttcaagacataaaataacaaagatattcatggcctaaactgagtactggatcaaatggacctgatagatatctacaaaattctccacccagaaacaacagaatagacattcttctcatcagcccatggcacttactctaaaattgatcacataattggaagtaaaacactcctcagcaaaagcaaaagaaatgaaattaaaaacgtctcttgtactgccgtgcaaattcaaaatcaagagtaagaaattcactcaaaactatgcaattccatggaaattgaataacctgctcctgaatgacttgtgggtatataatgagataaaagcaggaatcaagaagttctttgaaactaatgagaacaaagatatgacacaccagaatctctgggacacagctaaggcagaattaaaagggaaatttatagcactaaatgcccacattaaaagttagaaatatct

SEQ ID NO: 4935 - DNA, 2687 bp, Artificial Sequence
  Synthetic polypeptide
atgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagccatcaccgatgattcctccaggtactgtaaaatctgaggcaactagcgattggagtcgaccccccagcacaacacagcagccctgcagaaaagtggctagactgtttaaaaaaaaaaaaaagaaaagaaaaaaaaggacaagctccactcaaaggtcaccaacctcaaagattgaaggcagataagcccacaaagatgagaaaggatcagtacaagaacattgaaaactcaaaatgccacagtgccctctttcctccaaatgactgcatcacttctccagcaaggtttcggaaccgggttgaggctgagatgcctgaaatgacagaagtagaattcataatatggatagggacaaagtttactgaggtaaaggagcgtgttgtaacccaattctaggaagctaaaaatcatgttaaaacattgcaggaactgacagtaaaatgagccagtttagagaagaatagagctgaaaaatactacaaatgctgtcacaagtattgatagcagtatagaccaagtgaaggaaagaatcttagagttgaagactgtctttctgaaataatacaggcagacaagaatagagaaaaaggaatgaacaaaaccaccaagaaatatgtgattatgtgaagagactgaatctatgactgattggtgtacttgaaagagataggaagaatggaaccagcttggaaaacatattccaggatataatccatgagaactttcccaacatagctagataggccaacattcaaattcaggaaatgcagagaacctcagtaagatactacttgagaagatcatccccaagacacatactcatcagattctccaaggacaaaatgagagaaaaaatgttaaaggcagctagagggaaaggccaggttacctacaaagggaagcccatcagcctaacagtggacctctcagctgaaaccctgcaagccagaagagattggaggccaatgttcaacattcttagaaaaaagaaattccaatccagaatttcatatccgaccacattaagctttatacgtgaaggagaaataagattctttcaagacaagcaaatgctgagggaatttgttaccaccagacctgtcttaacaagagttattgagagaagtactaaatatggacaggaaagactatcaccatccacgacaaaaacacactgaagtacacagaccagtgatactataaagcaatcacataagtctgcagaataaccagctaacatcatgatgacaggatcaaatccacacatttcaattctaatcttatatgtaaatggtctaaatacaccaattaaaatacatagagtggcaagctggataaagaaccaggacctattggtatcctgtcttcaagagacccttctcatatgcaatgacacacataagtcaaaataaatagatgaaggaaagtctaccaagcaaatagaaaacagaaaaatgcaggagttgcaattctagtttctgacaaaacagactttaaaccaacaaagataaaaaaaaagacaaagaagggcatcacgtaacggtaaaggattcaattcaacaagaagagcttactgtcctaaatatatatgcacataacacaggagcacccagattcataaggcaagttcttagagaccttcaaagagacttagactcccacacaataatagtggtagactttaacagcctattgaaaatattaattaattttcaagacataaaataacaaagatattcatggcctaaactgagtactggatcaaatggacctgatagatatctacaaaattctccacccagaaacaacagaatagacattcttctcatcagcccatggcacttactctaaaattgatcacataattggaagtaaaacactcctcagcaaaagcaaaagaaatgaaattaaaaacgtctcttgtactgccgtgcaaattcaaaatcaagagtaagaaattcactcaaaactatgcaattccatggaaattgaataacctgctcctgaatgacttgtgggtatataatgagataaaagcaggaatcaagaagttctttgaaactaatgagaacaaagatatgacacaccagaatctctgggacacagctaaggcagaattaaaagggaaatttatagcactaaatgcccacattaaaagttagaaatatct

SEQ ID NO: 4936 - DNA, 3566 bp, Artificial Sequence
  Synthetic polypeptide
atgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagccatcaccgatgattcctccaggtactgtaaaatctgaggcaactagcgattggagtcgaccccccagcacaacacagcagccctgcagaaaagtggctagactgtttaaaaaaaaaaaaaagaaaagaaaaaaaaggacaagctccactcaaaggtcaccaacctcaaagattgaaggcagataagcccacaaagatgagaaaggatcagtacaagaacattgaaaactcaaaatgccacagtgccctctttcctccaaatgactgcatcacttctccagcaaggtttcggaaccgggttgaggctgagatgcctgaaatgacagaagtagaattcataatatggatagggacaaagtttactgaggtaaaggagcgtgttgtaacccaattctaggaagctaaaaatcatgttaaaacattgcaggaactgacagtaaaatgagccagtttagagaagaatagagctgaaaaatactacaaatgctgtcacaagtattgatagcagtatagaccaagtgaaggaaagaatcttagagttgaagactgtctttctgaaataatacaggcagacaagaatagagaaaaaggaatgaacaaaaccaccaagaaatatgtgattatgtgaagagactgaatctatgactgattggtgtacttgaaagagataggaagaatggaaccagcttggaaaacatattccaggatataatccatgagaactttcccaacatagctagataggccaacattcaaattcaggaaatgcagagaacctcagtaagatactacttgagaagatcatccccaagacacatactcatcagattctccaaggacaaaatgagagaaaaaatgttaaaggcagctagagggaaaggccaggttacctacaaagggaagcccatcagcctaacagtggacctctcagctgaaaccctgcaagccagaagagattggaggccaatgttcaacattcttagaaaaaagaaattccaatccagaatttcatatccgaccacattaagctttatacgtgaaggagaaataagattctttcaagacaagcaaatgctgagggaatttgttaccaccagacctgtcttaacaagagttattgagagaagtactaaatatggacaggaaagactatcaccatccacgacaaaaacacactgaagtacacagaccagtgatactataaagcaatcacataagtctgcagaataaccagctaacatcatgatgacaggatcaaatccacacatttcaattctaatcttatatgtaaatggtctaaatacaccaattaaaatacatagagtggcaagctggataaagaaccaggacctattggtatcctgtcttcaagagacccttctcatatgcaatgacacacataagtcaaaataaatagatgaaggaaagtctaccaagcaaatagaaaacagaaaaatgcaggagttgcaattctagtttctgacaaaacagactttaaaccaacaaagataaaaaaaaagacaaagaagggcatcacgtaacggtaaaggattcaattcaacaagaagagcttactgtcctaaatatatatgcacataacacaggagcacccagattcataaggcaagttcttagagaccttcaaagagacttagactcccacacaataatagtggtagactttaacagcctattgaaaatattaattaattttcaagacataaaataacaaagatattcatggcctaaactgagtactggatcaaatggacctgatagatatctacaaaattctccacccagaaacaacagaatagacattcttctcatcagcccatggcacttactctaaaattgatcacataattggaagtaaaacactcctcagcaaaagcaaaagaaatgaaattaaaaacgtctcttgtactgccgtgcaaattcaaaatcaagagtaagaaattcactcaaaactatgcaattccatggaaattgaataacctgctcctgaatgacttgtgggtatataatgagataaaagcaggaatcaagaagttctttgaaactaatgagaacaaagatatgacacaccagaatctctgggacacagctaaggcagaattaaaagggaaatttatagcactaaatgcccacattaaaagttagaaatatct

SEQ ID NO: 4937 - DNA, 3765 bp, Artificial Sequence
  Synthetic polypeptide
atgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatgttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtggaagtgatgattggatcattggagcggcttccc

SEQ ID NO: 4938 - DNA, 3906 bp, Artificial Sequence
  Synthetic polypeptide
atgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtggaagtgatgattggatcattggagcggcttccc

SEQ ID NO: 4939 - DNA, 1108 bp, Artificial Sequence
  Synthetic polypeptide
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaaga

SEQ ID NO: 4940 - DNA, 1333 bp, Artificial Sequence
  Synthetic polypeptide
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatggcaccctcctgtcgggcgccaaagtggccgccgcggcggggctggcggtggagcgggaaggccggctgggggagaagccggcaccggtgccgccacccggagaggacgccttgagaagcggcggggctgcccccagcgagccgggcagcggtggcaaggcggggagaggccgctggcggacggtgcagagccacctggccgcagggaagctcaacttgtccaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaaga

SEQ ID NO: 4941 - DNA, 1957 bp, Artificial Sequence
  Synthetic polypeptide
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaatggcaccctcctgtcgggcgccaaagtggccgccgcggcggggctggcggtggagcgggaaggccggctgggggagaagccggcaccggtgccgccacccggagaggacgccttgagaagcggcggggctgcccccagcgagccgggcagcggtggcaaggcggggagaggccgctggcggacggtgcagagccacctggccgcagggaagctcaacttgtccaatttcgaggactccaccctgtccacggccactacccttgagtctatccccagctccacgggagagccgaaatgccagcgaccccgcaccctgatgcggcagcagagcctgcaacagccgctgagccagcaccagcggggccggcagcccagccagcccaccaccagccagagcctgggccagctgcaggcccacatggcctcggcaccaggccccaacccccgggcctatggccggggccaggctcggcagggcacctcggccggctccaagtaccgggcggcagggggccgcagccgctccaacccaggcagctgggaccacgtggtggggcagattcgaaaccgaggcttggacatgaaatccttcctggaaggccggatggtggtgctatccttggtcttagggctttcggaacaggatgactttgccaatatccctgacctgcaaaacccaggaacccagcagaaccagaacgctcagggggacaagaggttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaaga

SEQ ID NO: 4942 - DNA, 1240 bp, Artificial Sequence
  Synthetic polypeptide
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaaga

SEQ ID NO: 4943 - DNA, 1732 bp, Artificial Sequence
  Synthetic polypeptide
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaatttcgaggactccaccctgtccacggccactacccttgagtctatccccagctccacgggagagccgaaatgccagcgaccccgcaccctgatgcggcagcagagcctgcaacagccgctgagccagcaccagcggggccggcagcccagccagcccaccaccagccagagcctgggccagctgcaggcccacatggcctcggcaccaggccccaacccccgggcctatggccggggccaggctcggcagggcacctcggccggctccaagtaccgggcggcagggggccgcagccgctccaacccaggcagctgggaccacgtggtggggcagattcgaaaccgaggcttggacatgaaatccttcctggaaggccggatggtggtgctatccttggtcttagggctttcggaacaggatgactttgccaatatccctgacctgcaaaacccaggaacccagcagaaccagaacgctcagggggacaagaggttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaaga

SEQ ID NO: 4944 - DNA, 1465 bp, Artificial Sequence
  Synthetic polypeptide
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaatggcaccctcctgtcgggcgccaaagtggccgccgcggcggggctggcggtggagcgggaaggccggctgggggagaagccggcaccggtgccgccacccggagaggacgccttgagaagcggcggggctgcccccagcgagccgggcagcggtggcaaggcggggagaggccgctggcggacggtgcagagccacctggccgcagggaagctcaacttgtccaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaaga

SEQ ID NO: 4945 - DNA, 1808 bp, Artificial Sequence
  Synthetic polypeptide
atggtgccacccaaattgcatgtgcttttctgcctctgcggctgcctggctgtggtttatccttttgactggcaatacataaatcctgttgcccatatgaaatcatcagcatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggactctattgatagggaaaaaatagcagtaattggacattcttttggtggagcaacggttattcagactcttagtgaagatcagagattcagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggggttcagtccaccagaattttgctgacttcacttttgcaactggcaaaataattggacacatgctcaaattaaagggagacatagattcaaatgtagctattgatcttagcaacaaagcttcattagcattcttacaaaagcatttagaactgtgtggtggagcagaggctgagagaaaaatactgtctggctaggtgaccagaaaaaggggccattggaggctggataagagaggatcctgggagccagaaaatgtggaggacatctcagagaggaaaggagttgaaaatgtttaactcctaatgctacatgtgaactctaagtctcaggattgcccctgagctatgcacatgcagaacagagccaaataagcacagcaaagtctttgacacttaactactatataaaccactgaccaaagtccctgactaccctgggtggcttatgtacctggaagacctgaacaacaaaggctttgaaaactaaactgacaggacaatcaccaaccacagaaggagaaagagaacatgtaggatgaattgaaaccagctgatcatctgctgtaacaaaaacttcaacattctccagattttaacaggacccaatgtcttaaaacataatatgcaaaatgttcaggatataatccaaaattactcaacatacaaagaaccaagaaaagctgaccatttctctagggaaaagaaaatcaacagctacaaaccccaagatgaccagatattaaaactatcagacaaagattgtgaag

SEQ ID NO: 4946 - DNA, 458 bp, Artificial Sequence
  Synthetic polypeptide
atggccaagtatggagaacatgaagccagtcctgacaatgggcagaacgaattcagtgatatcattaagtccagatctgccctctcctactacaggagagagagataatggccctttgctcctcattccgcattcagaccagattccccagctgcaatctcctgccatcggattgcatcaccaactcaacctaattggtgagatgtcactccctccctccaccgctcactctcatttctcagtgagtttagctctgtcactctctctaaaagttactcttgttttagtgatttgggtgtaaacattgatgatccttctaatactctgtcctcttaatttctctaagttctctttctagtgatcttgtctcccagtgtggtgggtatattctggctagaccaggtcattgtttatggtggcagcccctctgtcatctgaatttaagcgtcccatttttt

SEQ ID NO: 4947 - DNA, 377 bp, Artificial Sequence; identical to SEQ ID NO: 299
  Synthetic polypeptide

SEQ ID NO: 4948 - DNA, 377 bp, Artificial Sequence; identical to SEQ ID NO: 300
  Synthetic polypeptide

SEQ ID NO: 4949 - DNA, 1420 bp, Artificial Sequence
  Synthetic polypeptide
atggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcagggcagatgattctggaccagatgaagcctgaggagccttccagctctaagat

SEQ ID NO: 4950 - DNA, 1462 bp, Artificial Sequence
  Synthetic polypeptide
atggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactagtctcattctgtcaaggggcgtgatcaaggcttattgcaacctccgcctcccaggctcagacagctctcctgtctcagtctcccaacttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcagggcagatgattctggaccagatgaagcctgaggagccttccagctctaagat

SEQ ID NO: 4951 - DNA, 70 bp, Artificial Sequence
  Synthetic polypeptide
ggtcgtgcctcccagcagggcagatgattctggaccagatgaagcctgaggagccttccagctctaagat

SEQ ID NO: 4952 - DNA, 451 bp, Artificial Sequence; identical to SEQ ID NO: 339
  Synthetic polypeptide

SEQ ID NO: 4953 - DNA, 1300 bp, Artificial Sequence
  Synthetic polypeptide
atgagccgcagcctggactcggcgcggagcttcctggagcggctggaagcgcggggcggccgggagggggcagtcctcgccggcgagttcagcgacatccaggcctgctcggccgcctggaaggctgacggcgtgtgctccaccgtggccggcagtcggccagagaacgtgaggaagaaccgctacaaagacgtgctgccttatgatcagacgcgagtaatcctctccctgctccaggaagagggacacagcgactacattaatggcaacttcatccggggcgtggatggaagcctggcctacattgccacgcaaggacccttgcctcacaccctgctagacttctggagactggtctgggagtttggggtcaaggtgatcctgatggcctgtcgagagatagagaatgggcggaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggtggctcacccctgtaatcccagcacttcgggaggccaaggagggcggatcacttgagcccagctggagaccagcctggttaacatggtgaaaccctgtctctactaaaaatacaaaaattagccaggcgtgctggtgagagcctgtaatcccagctactccggaggctgaggcaggagagtcgcttgagcccgggaggtggaggttgcagtaagccgagatcgcaccacggcagtccagcctgggcgacagagcgagatcctgtctcaaaaaaacaacaaaaaaaa

SEQ ID NO: 4954 - DNA, 979 bp, Artificial Sequence
  Synthetic polypeptide
atgagccgcagcctggactcggcgcggagcttcctggagcggctggaagcgcggggcggccgggagggggcagtcctcgccggcgagttcagcaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggtggctcacccctgtaatcccagcacttcgggaggccaaggagggcggatcacttgagcccagctggagaccagcctggttaacatggtgaaaccctgtctctactaaaaatacaaaaattagccaggcgtgctggtgagagcctgtaatcccagctactccggaggctgaggcaggagagtcgcttgagcccgggaggtggaggttgcagtaagccgagatcgcaccacggcagtccagcctgggcgacagagcgagatcctgtctcaaaaaaacaacaaaaaaaa

SEQ ID NO: 4955 - DNA, 713 bp, Artificial Sequence
  Synthetic polypeptide
agaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggtggctcacccctgtaatcccagcacttcgggaggccaaggagggcggatcacttgagcccagctggagaccagcctggttaacatggtgaaaccctgtctctactaaaaatacaaaaattagccaggcgtgctggtgagagcctgtaatcccagctactccggaggctgaggcaggagagtcgcttgagcccgggaggtggaggttgcagtaagccgagatcgcaccacggcagtccagcctgggcgacagagcgagatcctgtctcaaaaaaacaacaaaaaaaa

SEQ ID NO: 4956 - DNA, 572 bp, Artificial Sequence; identical to SEQ ID NO: 159
  Synthetic polypeptide

SEQ ID NO: 4957 - DNA, 475 bp, Artificial Sequence
  Synthetic polypeptide
atgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggatcactgg

SEQ ID NO: 4958 - DNA, 1502 bp, Artificial Sequence
  Synthetic polypeptide
atggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgaatctgttgacttgcttgatcgtggtatctccagcacctagagcagtgcctggcacatagtaggttctcagctaaatgtttgttgacagaat

SEQ ID NO: 4959 - DNA, 610 bp, Artificial Sequence
  Synthetic polypeptide
caccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgaatctgttgacttgcttgatcgtggtatctccagcacctagagcagtgcctggcacatagtaggttctcagctaaatgtttgttgacagaat

SEQ ID NO: 4960 - DNA, 651 bp, Artificial Sequence
  Synthetic polypeptide
atggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccaggccgtgcgtggtggctcacacgtgtaattccaacactttgggaggccgaggtgggcggatcacctgaggtcgggagttccaggccaacctgaccaacatggagaaaccccgtctctactaaaaatacaaaattagccgggcgtggtggcgcatgcctgtaatcccagctactcgggaggctgaggcaggagaattgcttgaacccaggaggcggagtttgcagtgagctgagattgcgccattgcactccagcctgggtgggcaacaagagcaaaactctgtctcaaaaaaaaaaaccaaaaaaaaaaaa

SEQ ID NO: 4961 - DNA, 699 bp, Artificial Sequence
  Synthetic polypeptide
atgcggatccctgagtgggtggctggctccccggtcttcacccctcagatgcaccgatctacccccgtctgtcctcttggcctccagaggtgtcctggccactggaggggcaggggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccaggccgtgcgtggtggctcacacgtgtaattccaacactttgggaggccgaggtgggcggatcacctgaggtcgggagttccaggccaacctgaccaacatggagaaaccccgtctctactaaaaatacaaaattagccgggcgtggtggcgcatgcctgtaatcccagctactcgggaggctgaggcaggagaattgcttgaacccaggaggcggagtttgcagtgagctgagattgcgccattgcactccagcctgggtgggcaacaagagcaaaactctgtctcaaaaaaaaaaaccaaaaaaaaaaaa

SEQ ID NO: 4962 - DNA, 1279 bp, Artificial Sequence
  Synthetic polypeptide
atgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggtgctgcccctggaattcccagaacatcaacatcagctcccgtcctcatcaaagggtggaaaaaaggaaagcttgaaccagcttgggaaggaccttatctagtgctcctggccactgaaactgcatccgaacagcaaaaaaaggatgaactcatcatactcgagtgaaaaaacatcaccacctccggagtcacgggctactgttccaggggaaagtgctacctaactaaagctaagaaaaacccaaccctcct

SEQ ID NO: 4963 - DNA, 742 bp, Artificial Sequence
  Synthetic polypeptide
atgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggtgctgcccctggaattcccagaacatcaacatcagctcccgtcctcatcaaagggtggaaaaaaggaaagcttgaaccagcttgggaaggaccttatctagtgctcctggccactgaaactgcatccgaacagcaaaaaaaggatgaactcatcatactcgagtgaaaaaacatcaccacctccggagtcacgggctactgttccaggggaaagtgctacctaactaaagctaagaaaaacccaaccctcct

SEQ ID NO: 4964 - DNA, 700 bp, Artificial Sequence
  Synthetic polypeptide
atggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacactgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacccgttggcacctctgcctatcctgacccccagctgatgcccctgcttccagattcagcaacgaagcctcccccgtggtcccaccaccatgtccacctgcc

SEQ ID NO: 4965 - DNA, 263 bp, Artificial Sequence
  Synthetic polypeptide
atggccgccgctacggcctccccccgcagcctccttgttctcctccaggtggtagtgctcgctctggcgcagattagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggttactatgggaa

SEQ ID NO: 4966 - DNA, 228 bp, Artificial Sequence
  Synthetic polypeptide
gtctcccttccgagggccgccgggggctgcgggcgcgcggagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggttactatgggaa

SEQ ID NO: 4967 - DNA, 294 bp, Artificial Sequence
  Synthetic polypeptide
atgtggaatctccttcacgaaaccgactcggctgtggccaccgcgcgccgcccgcgctggctgtgcgctggggcgctggtgctggcgggtggcttctttctcctcggcttcctcttcggcctccatcctcttcatcctgttcatttttcagatctcagttcaagcatctcgtcctcagtgtggtgtttcctgatccctcactctaatccaagtctttctgttttatgcacaggtggaatcttatttccgtttgcgtgcaatcatgtattttaatatgcatgtatatatgtatgt

SEQ ID NO: 4968 - DNA, 468 bp, Artificial Sequence
  Synthetic polypeptide
atggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtaaaatgtgagctgcaagagatcagggac

SEQ ID NO: 4969 - DNA, 1757 bp, Artificial Sequence
  Synthetic polypeptide
atgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagttctagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaactgagaaacctgaacggactccatttggctccttcatttgcaagacatcaagggctccttacccacccccttcctcaaggaattaacttgtgcaagctgactcccagcacatcaaagaatgcaattaactgataacatgctgtggcaagctatgtccgcagttcccaggaatttgtccagttgatattaccctaagcccctgtgtttttgtctggttgatagcacccaaagcccagcgtctatcaccttgtgatggatttaaagcccctgcacctggaactgtttgctttcctgtaaccatttgtctttttaacttcttttgcctgttttacttctgtaagactgctacagctaggctccccctcccctctctaaaccaaagtataaaacaaaatctagccccttcttcagggccgagagaattttgagcactagccgtctctcggtcgctggctaataaaggactcctcaattcgtctcagagtgtggcgtttctgtataactcgctcggttacaaca

SEQ ID NO: 4970 - DNA, 1751 bp, Artificial Sequence
  Synthetic polypeptide
atgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaactgagaaacctgaacggactccatttggctccttcatttgcaagacatcaagggctccttacccacccccttcctcaaggaattaacttgtgcaagctgactcccagcacatcaaagaatgcaattaactgataacatgctgtggcaagctatgtccgcagttcccaggaatttgtccagttgatattaccctaagcccctgtgtttttgtctggttgatagcacccaaagcccagcgtctatcaccttgtgatggatttaaagcccctgcacctggaactgtttgctttcctgtaaccatttgtctttttaacttcttttgcctgttttacttctgtaagactgctacagctaggctccccctcccctctctaaaccaaagtataaaacaaaatctagccccttcttcagggccgagagaattttgagcactagccgtctctcggtcgctggctaataaaggactcctcaattcgtctcagagtgtggcgtttctgtataactcgctcggttacaaca

SEQ ID NO: 4971 - DNA, 559 bp, Artificial Sequence; identical to SEQ ID NO: 1701
  Synthetic polypeptide

SEQ ID NO: 4972 - DNA, 1168 bp, Artificial Sequence; identical to SEQ ID NO: 1703
  Synthetic polypeptide

SEQ ID NO: 4973 - DNA, 640 bp, Artificial Sequence; identical to SEQ ID NO: 1700
  Synthetic polypeptide

SEQ ID NO: 4974 - DNA, 1598 bp, Artificial Sequence; identical to SEQ ID NO: 1699
  Synthetic polypeptide

SEQ ID NO: 4975 - DNA, 3992 bp, Artificial Sequence; identical to SEQ ID NO: 120
  Synthetic polypeptide

SEQ ID NO: 4976 - DNA, 3845 bp, Artificial Sequence; identical to SEQ ID NO: 121
  Synthetic polypeptide

SEQ ID NO: 4977 - DNA, 412 bp, Artificial Sequence; identical to SEQ ID NO: 1704
  Synthetic polypeptide

SEQ ID NO: 4978 - DNA, 4024 bp, Artificial Sequence; identical to SEQ ID NO: 1712
  Synthetic polypeptide

SEQ ID NO: 4979 - DNA, 4060 bp, Artificial Sequence; identical to SEQ ID NO: 1713
  Synthetic polypeptide

SEQ ID NO: 4980 - DNA, 1737 bp, Artificial Sequence
  Synthetic polypeptide
atgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattgcacctaactggaaatgactcaaacgtccaccagtaggagagaggagaaataaattgtggtatgttcatacaatagaatactatattatttgaaagactactgaatcatttagaaacatgcatcagtttcacaga

SEQ ID NO: 4981 - DNA, 1302 bp, Artificial Sequence
  Synthetic polypeptide
atggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaaggatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattgcacctaactggaaatgactcaaacgtccaccagtaggagagaggagaaataaattgtggtatgttcatacaatagaatactatattatttgaaagactactgaatcatttagaaacatgcatcagtttcacaga

SEQ ID NO: 4982 - DNA, 1455 bp, Artificial Sequence
  Synthetic polypeptide
atggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattgcacctaactggaaatgactcaaacgtccaccagtaggagagaggagaaataaattgtggtatgttcatacaatagaatactatattatttgaaagactactgaatcatttagaaacatgcatcagtttcacaga

SEQ ID NO: 4983 - DNA, 1734 bp, Artificial Sequence
  Synthetic polypeptide
atgaacctagagcggctgcggaagcgcgtccggcagtacctcgaccagcaacagtatcaaagtgctctattttgggcagataaagtagcttcactctctcgtgaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattgcacctaactggaaatgactcaaacgtccaccagtaggagagaggagaaataaattgtggtatgttcatacaatagaatactatattatttgaaagactactgaatcatttagaaacatgcatcagtttcacaga

SEQ ID NO: 4984 - DNA, 225 bp, Artificial Sequence; identical to SEQ ID NO: 1702
  Synthetic polypeptide

SEQ ID NO: 4985 - DNA, 1273 bp, Artificial Sequence; identical to SEQ ID NO: 1927
  Synthetic polypeptide

SEQ ID NO: 4986 - DNA, 1516 bp, Artificial Sequence; identical to SEQ ID NO: 1928
  Synthetic polypeptide

SEQ ID NO: 4987 - DNA, 1393 bp, Artificial Sequence; identical to SEQ ID NO: 1929
  Synthetic polypeptide

SEQ ID NO: 4988 - DNA, 500 bp, Artificial Sequence; identical to SEQ ID NO: 204
  Synthetic polypeptide

SEQ ID NO: 4989 - DNA, 656 bp, Artificial Sequence; identical to SEQ ID NO: 205
  Synthetic polypeptide

SEQ ID NO: 4990 - DNA, 524 bp, Artificial Sequence; identical to SEQ ID NO: 207
  Synthetic polypeptide

SEQ ID NO: 4991 - DNA, 442 bp, Artificial Sequence; identical to SEQ ID NO: 1723
  Synthetic polypeptide

SEQ ID NO: 4992 - DNA, 966 bp, Artificial Sequence
  Synthetic polypeptide
atggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagagacaaaaagccccaaggaaaccaggaggctgggaagacagtccaatccagcaagacagaactctgaccgtcactgcctcactccagtgccaggcgcaaagaagtcagcaggtccgtcccaccccatctgcaaagtggtgcggactgggggtggcccaggacctccaccctgggctagcagtaatgaggagctagtccccctccccaccaggtggatgtcagaggctaagcaggggacctagacctccccgactcagtggctaaggggatgcacctgtttctctgcttgcatggtgaggcctgctaaacaagataaataaagtccatagtctcgtcaggtagtgcctcaaatgtccgggatctaatcgacactgattaccaggaaaatctcaactttcagagatttcaaatgagaaaaaacattcagcagaagacaccaaggctgagattgtacaaatgttggaattatgtgacaagagttttaaacagccctcttgattcagcaagcaatttagaacatgcttgaaacaaatgaaaacatttaaagtctcaacaaggaaataggcgatataaagaagaaccaaatggaaattttagaa

SEQ ID NO: 4993 - DNA, 960 bp, Artificial Sequence
  Synthetic polypeptide
atgcgtctgacagatgttgttcaacagcttgtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagagacaaaaagccccaaggaaaccaggaggctgggaagacagtccaatccagcaagacagaactctgaccgtcactgcctcactccagtgccaggcgcaaagaagtcagcaggtccgtcccaccccatctgcaaagtggtgcggactgggggtggcccaggacctccaccctgggctagcagtaatgaggagctagtccccctccccaccaggtggatgtcagaggctaagcaggggacctagacctccccgactcagtggctaaggggatgcacctgtttctctgcttgcatggtgaggcctgctaaacaagataaataaagtccatagtctcgtcaggtagtgcctcaaatgtccgggatctaatcgacactgattaccaggaaaatctcaactttcagagatttcaaatgagaaaaaacattcagcagaagacaccaaggctgagattgtacaaatgttggaattatgtgacaagagttttaaacagccctcttgattcagcaagcaatttagaacatgcttgaaacaaatgaaaacatttaaagtctcaacaaggaaataggcgatataaagaagaaccaaatggaaattttagaa

SEQ ID NO: 4994 - DNA, 1128 bp, Artificial Sequence
  Synthetic polypeptide
atggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatatcctttgtcgttcatggcagctgtcccgcatagaacacatgcagtggattacttgggacttgagacccggaaacactgggccagttgctcatttctgcagttagaaaggaatgacagtgttttggaacagaagctcgtttcagctctttcacttggtacatcattcttgcgagcattccaggcccacaaagaagaaaactgggctctgcctgtcatgtatgcagtagcgcttgaccttcgagtgtttgccaataatgcagagacaaaaagccccaaggaaaccaggaggctgggaagacagtccaatccagcaagacagaactctgaccgtcactgcctcactccagtgccaggcgcaaagaagtcagcaggtccgtcccaccccatctgcaaagtggtgcggactgggggtggcccaggacctccaccctgggctagcagtaatgaggagctagtccccctccccaccaggtggatgtcagaggctaagcaggggacctagacctccccgactcagtggctaaggggatgcacctgtttctctgcttgcatggtgaggcctgctaaacaagataaataaagtccatagtctcgtcaggtagtgcctcaaatgtccgggatctaatcgacactgattaccaggaaaatctcaactttcagagatttcaaatgagaaaaaacattcagcagaagacaccaaggctgagattgtacaaatgttggaattatgtgacaagagttttaaacagccctcttgattcagcaagcaatttagaacatgcttgaaacaaatgaaaacatttaaagtctcaacaaggaaataggcgatataaagaagaaccaaatggaaattttagaa

SEQ ID NO: 4995 - DNA, 1721 bp, Artificial Sequence; identical to SEQ ID NO: 1726
  Synthetic polypeptide

SEQ ID NO: 4996 - DNA, 312 bp, Artificial Sequence; identical to SEQ ID NO: 1728
  Synthetic polypeptide

SEQ ID NO: 4997 - DNA, 725 bp, Artificial Sequence; identical to SEQ ID NO: 1705
  Synthetic polypeptide

SEQ ID NO: 4998 - DNA, 815 bp, Artificial Sequence; identical to SEQ ID NO: 1706
  Synthetic polypeptide

SEQ ID NO: 4999 - DNA, 2466 bp, Artificial Sequence; identical to SEQ ID NO: 1682
  Synthetic polypeptide

SEQ ID NO: 5000 - DNA, 1806 bp, Artificial Sequence; identical to SEQ ID NO: 1683
  Synthetic polypeptide

SEQ ID NO: 5001 - DNA, 2412 bp, Artificial Sequence; identical to SEQ ID NO: 1684
  Synthetic polypeptide

SEQ ID NO: 5002 - DNA, 2211 bp, Artificial Sequence; identical to SEQ ID NO: 1685
  Synthetic polypeptide

SEQ ID NO: 5003 - DNA, 364 bp, Artificial Sequence; identical to SEQ ID NO: 1686
  Synthetic polypeptide

SEQ ID NO: 5004 - DNA, 520 bp, Artificial Sequence; identical to SEQ ID NO: 1727
  Synthetic polypeptide

SEQ ID NO: 5005 - DNA, 1558 bp, Artificial Sequence
  Synthetic polypeptide
atggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtgtttcttctgcatctggaagggcgtcaggtccactgggaaggtcgtctacttcacagccacttttccattcgccatgctcctggtgctgctggtccgagggctgacgctgccgggcgcgggcgcaggcatcaagttctatctgtatcctgacatcacccgccttgaggacccacaggtgtggattgacgctgggactcagatattcttctcttatgccatctgcctgggggctatgacctcgctggggagctacaacaagtacaagtataactcgtacagggactgtatgctgctgggatgcctgaacagtggtaccagttttgtgtctggcttcgcaattttttccatcctgggcttcatggcacaagagcaaggggtggacattgctgatgtggctgagtcaggtcctggcctggccttcattgcctacccaaaagctgtgacaatgatgccgctgcccacattttggtccattcttttttttattatgcttctcttgcttggactggatagccagtttgttgaagttgaaggacagatcacatccttggttgatctttacccatccttcctaaggaagggttatcgtcgggaaatcttcatcgccttcgtgtgtagcatcagctacctgctggggctgacgatggtgacggagggtggcatgtatgtgtttcagctctttgactactatgcagctagcggtgtatgccttttgtgggttgcattctttgaatgttttgttattgcctggatatatggaggtgataacctttatgatggtattgaggacatgattggctatcggcccgggccctggatgaagtacagctgggctgtgatcactccagttctctgtgttgagactg

SEQ ID NO: 5006 - DNA, 1221 bp, Artificial Sequence; identical to SEQ ID NO: 122
  Synthetic polypeptide

SEQ ID NO: 5007 - DNA, 1081 bp, Artificial Sequence; identical to SEQ ID NO: 986
  Synthetic polypeptide

SEQ ID NO: 5008 - DNA, 1054 bp, Artificial Sequence; identical to SEQ ID NO: 987
  Synthetic polypeptide

SEQ ID NO: 5009 - DNA, 1146 bp, Artificial Sequence; identical to SEQ ID NO: 988
  Synthetic polypeptide

SEQ ID NO: 5010 - DNA, 646 bp, Artificial Sequence
  Synthetic polypeptide
atgacggccggcggccaggccgaggccgagggcgctggcggggagcccggcgcggcgcggctgccctcgcgggtggcccggctgctgtcggcgctcttctacgggacctgctccttcctcatcgtgcttgtcaacaaggcgctgctgaccacctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcccagtgcggtggctcacgcctataatcccagcactttgggaggctgaggcaggtggatcgcctgagatcaggagttcgagaccagcctggccaacatggcaaaacttcatttctactaaaaatacaaaaattagctgggcgtggtagtgtaatcccagctacccgagaggctgaggcaggagaatcgcttgaacccgggaggtggggattgcagtgagctgagatcgcgccactgcactccagcctgggtgacagagtgagactctatctctaaataaataaataaataaataaataa

SEQ ID NO: 5011 - DNA, 117 bp, Artificial Sequence; identical to SEQ ID NO: 928
  Synthetic polypeptide

SEQ ID NO: 5012 - DNA, 51 bp, Artificial Sequence; identical to SEQ ID NO: 929
  Synthetic polypeptide

SEQ ID NO: 5013 - DNA, 980 bp, Artificial Sequence; identical to SEQ ID NO: 139
  Synthetic polypeptide

SEQ ID NO: 5014 - DNA, 1256 bp, Artificial Sequence; identical to SEQ ID NO: 140
  Synthetic polypeptide

SEQ ID NO: 5015 - DNA, 1277 bp, Artificial Sequence; identical to SEQ ID NO: 142
  Synthetic polypeptide

SEQ ID NO: 5016 - DNA, 609 bp, Artificial Sequence; identical to SEQ ID NO: 249
  Synthetic polypeptide

SEQ ID NO: 5017 - DNA, 738 bp, Artificial Sequence; identical to SEQ ID NO: 250
  Synthetic polypeptide

SEQ ID NO: 5018 - DNA, 537 bp, Artificial Sequence; identical to SEQ ID NO: 251
  Synthetic polypeptide

SEQ ID NO: 5019 - DNA, 684 bp, Artificial Sequence; identical to SEQ ID NO: 253
  Synthetic polypeptide

SEQ ID NO: 5020 - DNA, 285 bp, Artificial Sequence; identical to SEQ ID NO: 255
  Synthetic polypeptide

SEQ ID NO: 5021 - DNA, 552 bp, Artificial Sequence; identical to SEQ ID NO: 254
  Synthetic polypeptide

SEQ ID NO: 5022 - DNA, 3723 bp, Artificial Sequence; identical to SEQ ID NO: 1743
  Synthetic polypeptide

SEQ ID NO: 5023 - DNA, 3708 bp, Artificial Sequence; identical to SEQ ID NO: 1744
  Synthetic polypeptide

SEQ ID NO: 5024 - DNA, 3333 bp, Artificial Sequence; identical to SEQ ID NO: 1745
  Synthetic polypeptide

SEQ ID NO: 5025 - DNA, 366 bp, Artificial Sequence; identical to SEQ ID NO: 1772
  Synthetic polypeptide

SEQ ID NO: 5026 - DNA, 679 bp, Artificial Sequence; identical to SEQ ID NO: 1729
  Synthetic polypeptide

SEQ ID NO: 5027 - DNA, 2501 bp, Artificial Sequence; identical to SEQ ID NO: 1164
  Synthetic polypeptide

SEQ ID NO: 5028 - DNA, 2552 bp, Artificial Sequence; identical to SEQ ID NO: 1165
  Synthetic polypeptide

SEQ ID NO: 5029 - DNA, 2456 bp, Artificial Sequence; identical to SEQ ID NO: 1166
  Synthetic polypeptide

SEQ ID NO: 5030 - DNA, 588 bp, Artificial Sequence; identical to SEQ ID NO: 1167
  Synthetic polypeptide

SEQ ID NO: 5031 - DNA, 1034 bp, Artificial Sequence; identical to SEQ ID NO: 4670
  Synthetic polypeptide

SEQ ID NO: 5032 - DNA, 1586 bp, Artificial Sequence; identical to SEQ ID NO: 4671
  Synthetic polypeptide

SEQ ID NO: 5033 - DNA, 1588 bp, Artificial Sequence; identical to SEQ ID NO: 4672
  Synthetic polypeptide

SEQ ID NO: 5034 - DNA, 1476 bp, Artificial Sequence; identical to SEQ ID NO: 3948
  Synthetic polypeptide

SEQ ID NO: 5035 - DNA, 4932 bp, Artificial Sequence; identical to SEQ ID NO: 3990
  Synthetic polypeptide

SEQ ID NO: 5036 - DNA, 1825 bp, Artificial Sequence; identical to SEQ ID NO: 1660
  Synthetic polypeptide

SEQ ID NO: 5037 - DNA, 1825 bp, Artificial Sequence; identical to SEQ ID NO: 1661
  Synthetic polypeptide

SEQ ID NO: 5038 - DNA, 1275 bp, Artificial Sequence
  Synthetic polypeptide
atggttcccgaggtgagggtcctctcctccttgctgggactcgcgctgctctggttccccctggactcccacgctcgagcccgcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaaggaggaatggacgaagaaagtggagctgttcagcctggagaagagaagactcagggggacaggactgctggcttcgtggctctgaagggctgtcccaggcagagggagcagctgtgttctgagtgaccgcaagagtcaaacaacaagcaggggctt

SEQ ID NO: 5039 - DNA, 1080 bp, Artificial Sequence
  Synthetic polypeptide
atggttcccgaggtgagggtcctctcctccttgctgggactcgcgctgctctggttccccctggactcccacgctcgagcccgcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaaggaggaatggacgaagaaagtggagctgttcagcctggagaagagaagactcagggggacaggactgctggcttcgtggctctgaagggctgtcccaggcagagggagcagctgtgttctgagtgaccgcaagagtcaaacaacaagcaggggctt

SEQ ID NO: 5040 - DNA, 1052 bp, Artificial Sequence; identical to SEQ ID NO: 247
  Synthetic polypeptide

SEQ ID NO: 5041 - DNA, 327 bp, Artificial Sequence; identical to SEQ ID NO: 246
  Synthetic polypeptide

SEQ ID NO: 5042 - DNA, 1189 bp, Artificial Sequence
  Synthetic polypeptide
atgggctggaggccccggagagctcgggggaccccgttgctgctgctgctactactgctgctgctctggccagtgccaggcgccggggtgcttcaaggacatatccctgggcagccagtcaccccgcactgggtcctggatggacaaccctggcgcaccgtcagcctggaggagccggtctcgaagccagacatggggctggtggccctggaggctgaaggccaggagctcctgcttgagctggagaagaaccacaggctgctggccccaggatacatagaaacccactacggcccagatgggcagccagtggtgctggcccccaaccacacggatcattgccactaccaagggcgagtaaggggcttccccgactcctgggtagtcctctgcacctgctctgggatgagtggcctgatcaccctcagcaggaatgccagctattatctgcgtccctggccaccccggggctccaaggacttctcaacccacgagatctttcggatggagcagctgctcacctggaaaggaacctgtggccacagggatcctgggaacaaagcgggcatgaccagccttcctggtggtccccagagcaggggcaggcgagaagcgcgcaggacccggaagtacctggaactgtacattgtggcagaccacaccctgttcttgactcggcaccgaaacttgaaccacaccaaacagcgtctcctggaagtcgccaactacgtggaccagcttctcaggactctggacattcaggtggcgctgaccggcctggaggtgtggaccgagcgggaccgcagccgcgtcacgcaggacgccaacgccacgctctgggccttcctgcagtggcgccgggggctgtgggcgcagcggccccacgactccgcgcagctgctcacgggccgcgccttccagggcgccacagtgggcctggcgcccgtcgagggcatgtgccgcgccgagagctcgggaggcgtgagcacggaccactcggagctccccatcggcgccgcagccaccatggcccatgagatcggccacagcctcggcctcagccacgaccccgacggctgctgcgtggaggctgcggccgagtccggaggctgcgtcatggctgcggccaccggggtggtttatgaggcttaaagggaagaagctcaggcaaagtggattctcaacggta

SEQ ID NO: 5043 - DNA, 2239 bp, Artificial Sequence
  Synthetic polypeptide
atggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgcaaggcccatcttttgcctacggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagagggcatggtagcacatacctgtggtcccaaatacttgggaggctgatttgggaggatcacttgagcccaggagtttgaggctgcagtgagccatgatcgcaccactggactccagcctggctgacagaatgggaccctatctcaaaaaataaaaaggacaaa

SEQ ID NO: 5044 - DNA, 2218 bp, Artificial Sequence
  Synthetic polypeptide
atggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagagggcatggtagcacatacctgtggtcccaaatacttgggaggctgatttgggaggatcacttgagcccaggagtttgaggctgcagtgagccatgatcgcaccactggactccagcctggctgacagaatgggaccctatctcaaaaaataaaaaggacaaa

SEQ ID NO: 5045 - DNA, 367 bp, Artificial Sequence
  Synthetic polypeptide
atggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggccacctgcgccccaccctcagcacctgtttttgcctgtgtgacctcagacaagtgactgcacctctctgagcctcagtttcctcctcagtaaaatgtggattgta

SEQ ID NO: 5046 - DNA, 767 bp, Artificial Sequence; identical to SEQ ID NO: 937
  Synthetic polypeptide

SEQ ID NO: 5047 - DNA, 677 bp, Artificial Sequence; identical to SEQ ID NO: 938
  Synthetic polypeptide

SEQ ID NO: 5048 - DNA, 3661 bp, Artificial Sequence
  Synthetic polypeptide
atgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggtcttgcacagtatagtggtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaacactattcacagtaacaaacatggaatgcccatcaatggtggactgcgtaaagaaaatgtggtgaacatacagcaagaaatactacgcagccataaaaaagaacaaaatcatgttctttgcagcaacacgggtgcctctggaagccattatcttgtgcaaattaacacagaaacatgaaaccaaatactgcatgctctcacttagaagtgggagctaaacatcgagtacacacggacgtaaagacgggaacaatagacactaggggctactagtagggggagaatagaaggaggctgaaggttgaaaaactgcctattgggaactatgctcactacctgggggacagaatcatttgtacaccacctctcagtgacatgccgtttacccatgtaacaaacctacacaatgtaccctctgaatctaaaataaaatttttaaaaaagaaaa

SEQ ID NO: 5049 - DNA, 3376 bp, Artificial Sequence
  Synthetic polypeptide
atgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaacactattcacagtaacaaacatggaatgcccatcaatggtggactgcgtaaagaaaatgtggtgaacatacagcaagaaatactacgcagccataaaaaagaacaaaatcatgttctttgcagcaacacgggtgcctctggaagccattatcttgtgcaaattaacacagaaacatgaaaccaaatactgcatgctctcacttagaagtgggagctaaacatcgagtacacacggacgtaaagacgggaacaatagacactaggggctactagtagggggagaatagaaggaggctgaaggttgaaaaactgcctattgggaactatgctcactacctgggggacagaatcatttgtacaccacctctcagtgacatgccgtttacccatgtaacaaacctacacaatgtaccctctgaatctaaaataaaatttttaaaaaagaaaa

SEQ ID NO: 5050 - DNA, 377 bp, Artificial Sequence; identical to SEQ ID NO: 2235
  Synthetic polypeptide

SEQ ID NO: 5051 - DNA, 347 bp, Artificial Sequence; identical to SEQ ID NO: 2236
  Synthetic polypeptide

SEQ ID NO: 5052 - DNA, 154 bp, Artificial Sequence; identical to SEQ ID NO: 2227
  Synthetic polypeptide

SEQ ID NO: 5053 - DNA, 2466 bp, Artificial Sequence; identical to SEQ ID NO: 1682
  Synthetic polypeptide

SEQ ID NO: 5054 - DNA, 1806 bp, Artificial Sequence; identical to SEQ ID NO: 1683
  Synthetic polypeptide

SEQ ID NO: 5055 - DNA, 2412 bp, Artificial Sequence; identical to SEQ ID NO: 1684
  Synthetic polypeptide

SEQ ID NO: 5056 - DNA, 2211 bp, Artificial Sequence; identical to SEQ ID NO: 1685
  Synthetic polypeptide

SEQ ID NO: 5057 - DNA, 364 bp, Artificial Sequence; identical to SEQ ID NO: 1686
  Synthetic polypeptide

SEQ ID NO: 5058 - DNA, 1398 bp, Artificial Sequence; identical to SEQ ID NO: 948
  Synthetic polypeptide

SEQ ID NO: 5059 - DNA, 1302 bp, Artificial Sequence; identical to SEQ ID NO: 949
  Synthetic polypeptide

SEQ ID NO: 5060 - DNA, 117 bp, Artificial Sequence; identical to SEQ ID NO: 928
  Synthetic polypeptide

SEQ ID NO: 5061 - DNA, 51 bp, Artificial Sequence; identical to SEQ ID NO: 929
  Synthetic polypeptide

SEQ ID NO: 5062 - DNA, 2409 bp, Artificial Sequence; identical to SEQ ID NO: 1481
  Synthetic polypeptide

SEQ ID NO: 5063 - DNA, 316 bp, Artificial Sequence; identical to SEQ ID NO: 1815
  Synthetic polypeptide

SEQ ID NO: 5064 - DNA, 1330 bp, Artificial Sequence
  Synthetic polypeptide
atggttcccgaggtgagggtcctctcctccttgctgggactcgcgctgctctggttccccctggactcccacgctcgagcccgcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaagatgaggaaactgaggctcagagaggtgaagtacctggcccaaggccacacagccagaggaatggacgaagaaagtggagctgttcagcctggagaagagaagactcagggggacaggactgctggcttcgtggctctgaagggctgtcccaggcagagggagcagctgtgttctgagtgaccgcaagagtcaaacaacaagcaggggctt

SEQ ID NO: 5065 - DNA, 3346 bp, Artificial Sequence
  Synthetic polypeptide
atggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacgggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccgggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccgggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggcccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggctactggggaggccgaggcggaagaatcgctggaacccaggaggcggaggttgcagtgagccgagattgcgccgttgcactccagcttgggtgacaaagcaagactccatctcaaaaaaaagacaagaaaaaagaaaga

SEQ ID NO: 5066 - DNA, 809 bp, Artificial Sequence; identical to SEQ ID NO: 2110
  Synthetic polypeptide

SEQ ID NO: 5067 - DNA, 644 bp, Artificial Sequence; identical to SEQ ID NO: 2111
  Synthetic polypeptide

SEQ ID NO: 5068 - DNA, 768 bp, Artificial Sequence; identical to SEQ ID NO: 2112
  Synthetic polypeptide

SEQ ID NO: 5069 - DNA, 427 bp, Artificial Sequence; identical to SEQ ID NO: 2113
  Synthetic polypeptide

SEQ ID NO: 5070 - DNA, 1216 bp, Artificial Sequence; identical to SEQ ID NO: 1380
  Synthetic polypeptide

SEQ ID NO: 5071 - DNA, 582 bp, Artificial Sequence; identical to SEQ ID NO: 4738
  Synthetic polypeptide

SEQ ID NO: 5072 - DNA, 546 bp, Artificial Sequence; identical to SEQ ID NO: 4739
  Synthetic polypeptide

SEQ ID NO: 5073 - DNA, 567 bp, Artificial Sequence; identical to SEQ ID NO: 4740
  Synthetic polypeptide

SEQ ID NO: 5074 - DNA, 552 bp, Artificial Sequence; identical to SEQ ID NO: 4741
  Synthetic polypeptide

SEQ ID NO: 5075 - DNA, 597 bp, Artificial Sequence; identical to SEQ ID NO: 4742
  Synthetic polypeptide

SEQ ID NO: 5076 - DNA, 2161 bp, Artificial Sequence; identical to SEQ ID NO: 288
  Synthetic polypeptide

SEQ ID NO: 5077 - DNA, 2140 bp, Artificial Sequence; identical to SEQ ID NO: 289
  Synthetic polypeptide

SEQ ID NO: 5078 - DNA, 529 bp, Artificial Sequence; identical to SEQ ID NO: 287
  Synthetic polypeptide

SEQ ID NO: 5079 - DNA, 344 bp, Artificial Sequence
  Synthetic polypeptide
ttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggtttgcttgcacttgctgtccttccaccatgggatgactctcatcagatgatggcaccatgttcttggacttctcagcctccagaactgtgagaaataaatttcttttctttataaattactcagttggtgacagactcaataacacaaaatagactaa

SEQ ID NO: 5080 - DNA, 375 bp, Artificial Sequence
  Synthetic polypeptide
atgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggtttgcttgcacttgctgtccttccaccatgggatgactctcatcagatgatggcaccatgttcttggacttctcagcctccagaactgtgagaaataaatttcttttctttataaattactcagttggtgacagactcaataacacaaaatagactaa

SEQ ID NO: 5081 - DNA, 339 bp, Artificial Sequence
  Synthetic polypeptide
atgtcgctcttgggacccaaggtgctgctgtttcttgctgcattcatcatcacctctgacgatgtgactcaagcgactccagaaacattcacagaagatcctaatctggtgaatgatcccgctacagatgaaacagttttggctgttttggctgatattgcaccttccacagatgacttggtttgcttgcacttgctgtccttccaccatgggatgactctcatcagatgatggcaccatgttcttggacttctcagcctccagaactgtgagaaataaatttcttttctttataaattactcagttggtgacagactcaataacacaaaatagactaa

SEQ ID NO: 5082 - DNA, 798 bp, Artificial Sequence; identical to SEQ ID NO: 3839
  Synthetic polypeptide

SEQ ID NO: 5083 - DNA, 110 bp, Artificial Sequence
  Synthetic polypeptide
atggctgtgcaacgccgtctagatgtcatggaggaggcattattctgagaagaggtctgtaggcttcaccacactgccaatggggtccatggcatacacagggaaaaacc

SEQ ID NO: 5084 - DNA, 236 bp, Artificial Sequence
  Synthetic polypeptide
atgcggcccctgctctgcgcgctgaccggactggccctgctccgcgccgcgggctctttggccgctgccgaacccttcagccctccgcgaggagactcagctcagagcacagcgtgtgacagacacatggctgtgcaacgccgtctagatgtcatggaggaggcattattctgagaagaggtctgtaggcttcaccacactgccaatggggtccatggcatacacagggaaaaacc

SEQ ID NO: 5085 - DNA, 465 bp, Artificial Sequence; identical to SEQ ID NO: 3964
  Synthetic polypeptide

SEQ ID NO: 5086 - DNA, 1206 bp, Artificial Sequence; identical to SEQ ID NO: 282
  Synthetic polypeptide

SEQ ID NO: 5087 - DNA, 1209 bp, Artificial Sequence; identical to SEQ ID NO: 281
  Synthetic polypeptide

SEQ ID NO: 5088 - DNA, 1203 bp, Artificial Sequence; identical to SEQ ID NO: 286
  Synthetic polypeptide

SEQ ID NO: 5089 - DNA, 1834 bp, Artificial Sequence; identical to SEQ ID NO: 133
  Synthetic polypeptide

SEQ ID NO: 5090 - DNA, 1765 bp, Artificial Sequence; identical to SEQ ID NO: 135
  Synthetic polypeptide

SEQ ID NO: 5091 - DNA, 884 bp, Artificial Sequence; identical to SEQ ID NO: 2542
  Synthetic polypeptide

SEQ ID NO: 5092 - DNA, 1673 bp, Artificial Sequence; identical to SEQ ID NO: 2326
  Synthetic polypeptide

SEQ ID NO: 5093 - DNA, 995 bp, Artificial Sequence
  Synthetic polypeptide
atgatcatcaccaaggccggcaggcgcatgtttccagcaatgagagtgaagatctctggattagatcctcaccagcaatattacattgccatggatattgtaccagtggacaacaaaagatacaggtatgtttaccacagttcgaaatggatggtggcaggtaatgctgactcgcctgtgccaccccgtgtgtacattcatccagactcgcctgcctcgggggagacttggatgagacaagttatcagcttcgacaagctgaagctcaccaacaatgaactggatgaccaaggccatattattcttcattctatgcacaaataccaaccgcgagtgcacgtcatccgtaaagactgtggagacgatctttctcccatcaagcctgttccatccggggagggagtaaaggcattctcctttccagaaactgtcttcacaaccgtcactgcctatcagaatcagcagattactcgcctgaagatagataggaatccatttgctaaaggcttccgagactccgggcgcaacagaatgggtttggaagccttggtggaatcatatgcattctggcgaccatcactacggactctgacctttgaagatatccctggaattcccaagcaagatgacactctcaccagtgccatgacagttgataatcaccatgacaacaactggaagaagtcataaaaggaaaaaaggaagacagcactactggttcagagaagtttaccaccctattctggaaaaggcatgaatattgctccctttgcttttactgtacaaacccttcattaaagagactctatattttaacctcgtcatccttcactagttgagaagttgatttgcaagccacattcccacttctctattccctggctattgaataaatcttgctttgcttgatgctcacttttggtttcatgtatttgctctgcaatacgtaattggaaacatcccatcttttggggctaccgggctttttagtaata

SEQ ID NO: 5094 - DNA, 1469 bp, Artificial Sequence
  Synthetic polypeptide
atggccgagaagcgaaggggctcgccgtgcagcatgctaagcctcaaggcgcacgctttctcggtggaggcgctgatcggcgccgagaagcagcaacagcttcagaagaagcggcgaaaactgggcgccgaagaggcggcgggggccgtggacgacggaggctgcagccgcggcggcggcgcgggcgaaaagggttcttctgagggagacgaaggcgctgcgctcccgccgccggctggggcgacgtctgggccggctcggagtggcgcagacctggagcgcggagccgcgggcggctgtgaggacggcttccagcagggagcttcccctctggcgtcaccgggaggctcccccaaggggtctccggcgcgctccctggcccggcccgggacccctctgccctcgccgcaggccccgcgggtggatctgcagggagccgagctctggaagcgctttcatgagataggcactgagatgatcatcaccaaggccggcaggcgcatgtttccagcaatgagagtgaagatctctggattagatcctcaccagcaatattacattgccatggatattgtaccagtggacaacaaaagatacaggtatgtttaccacagttcgaaatggatggtggcaggtaatgctgactcgcctgtgccaccccgtgtgtacattcatccagactcgcctgcctcgggggagacttggatgagacaagttatcagcttcgacaagctgaagctcaccaacaatgaactggatgaccaaggccatattattcttcattctatgcacaaataccaaccgcgagtgcacgtcatccgtaaagactgtggagacgatctttctcccatcaagcctgttccatccggggagggagtaaaggcattctcctttccagaaactgtcttcacaaccgtcactgcctatcagaatcagcagattactcgcctgaagatagataggaatccatttgctaaaggcttccgagactccgggcgcaacagaatgggtttggaagccttggtggaatcatatgcattctggcgaccatcactacggactctgacctttgaagatatccctggaattcccaagcaagatgacactctcaccagtgccatgacagttgataatcaccatgacaacaactggaagaagtcataaaaggaaaaaaggaagacagcactactggttcagagaagtttaccaccctattctggaaaaggcatgaatattgctccctttgcttttactgtacaaacccttcattaaagagactctatattttaacctcgtcatccttcactagttgagaagttgatttgcaagccacattcccacttctctattccctggctattgaataaatcttgctttgcttgatgctcacttttggtttcatgtatttgctctgcaatacgtaattggaaacatcccatcttttggggctaccgggctttttagtaata

SEQ ID NO: 5095 - DNA, 2084 bp, Artificial Sequence
  Synthetic polypeptide
atggagacttcccttagcctggagagtggccatcatgggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagctgagattgatctttcccaaggtatatgcacactccaaacctcattttcctctcctgtgaaatgggg

SEQ ID NO: 5096 - DNA, 2006 bp, Artificial Sequence
  Synthetic polypeptide
atggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagctgagattgatctttcccaaggtatatgcacactccaaacctcattttcctctcctgtgaaatgggg

SEQ ID NO: 5097 - DNA, 671 bp, Artificial Sequence; identical to SEQ ID NO: 2375
  Synthetic polypeptide

SEQ ID NO: 5098 - DNA, 353 bp, Artificial Sequence; identical to SEQ ID NO: 2376
  Synthetic polypeptide

SEQ ID NO: 5099 - DNA, 775 bp, Artificial Sequence; identical to SEQ ID NO: 215
  Synthetic polypeptide

SEQ ID NO: 5100 - DNA, 1400 bp, Artificial Sequence
  Synthetic polypeptide
atggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcgtaactcctgctcagactcctgcatgcccagggaggaaggtggaggggcaggaacaggacggacaggccccgggctctggcacatcctggggaacaagggaccacaaggacgggggcagtctccagacttcccctgggcgcttgaccccaggccttgcaggggagagagccagggcctccctcaggtctttgttcatgctgttttccctgccgtggacaccctttcccgctctctgattctctaaatcctgccccatctcccagatcttgttcatgtccaagcttttccaggaagtctt

SEQ ID NO: 5101 - DNA, 1989 bp, Artificial Sequence
  Synthetic polypeptide
atggccaagcctcggctgctagttctctacttcgctctgattgtggttccggcctgggtgtccagcattgtcctcacagggacaagcgagcccccagatgcgcagacagtggcgcctgcggaggacgagactctgcaaaacgaggcggacaaccaggagaacgttttatctcagttgctgggggactatgacaaggtcaaggctatgtctgagggctcggactgtcagtgcaagtgtgtggtgagacccctgggccgggatgcctgccagaggatcaatgcgggggcctccaggaaggaagacttctataccgtggaaaccatcacctcaggctcgtcgtgcaagtgtgcctgtgtagcacccccatcggccctcaatccctgcgagggagacttcaggctccagaagctgcgggaggcagacagccaggacttgaagctctccacaatcatagacatgttggaaggagcgttctatggcctggatctcctgaagctacattcagtcaccaccaaactggtggggcgagtggataaactggaggaggaagtgtctaaaaacctcaccaaggaaaatgaacaaatcaaagaggacatggaagaaattcgaaccgagatgaataagcgaggcaaagaaaattgctctgaaaacatcctagatagcatgccagacatccgctcagccctgcagagggatgcagcagcagcctacgcccacccagagtatgaagagcggtttctgcaggaagaaaccgtgtcccagcagatcaactccatcgaacttctgcagacgcgacccctggctctgcctgaggtggtgaagtcacagcggcccctgcagaggcaggtccacctgagaggccggccggcctcccagcccactgtcatccggggcatcacctactataaagccaaggtctctgaagaagagaatgacattgaagagcagcaagatgagtttttcagcggtgacaatggagtggatttgctgattgaagatcagctcctgagacacaacggcctgatgaccagtgtcacccggaggcctgcagccacccgtcagggacacagcactgctgtgacaagcgacctgaacgctcggaccgcaccctggtcctcagcactgccacagccctcgacctcagatcccagcatcgccaaccatgcctcagtgggaccaacactccaaacaacctcggtgtctccagatcccacaagggagtcagtcctgcagccttctcctcaggtaccagccaccactgtggcccacacagccacccagcaaccagcagccccagctcctccggcagtgtctcccagggaggcattgatggaagctatgcacacagtcccagtgcctcccaccacagtcagaacagactcgctggggaaagatgctcctgctgggtggggaacaacccctgccagccccacgctgagccccgaagaagaagatgacatccggaatgtcatagaggtgaagaagctgcagaaaaaagtctgaagctaacagaggctggttcgtgagatttagagaaagaagttgtctccataatgtaaaaatgcaagtgaaatagcaagtgctaatgcagaagctgtagcaagttatctagaagatctagctaagattgttgatgaaggtggctacactaaacaacagattttcagtgtaggcaaaacagccatccattggaagaaggtgccatctaggaccttcataattaaagaggagaggtcagtgcctggcttcaaagcttcaaaggacaaggtgactcttctgttaggggctaatgcagctggtgactttaaatcaaagccagtgctcatttaccattctaaaaatcctagggcccttaagaattatgcaaatctactctcctggtgctctatacatggaacaacaaagcttggataatagcacatctttttacagcatggtttactgaataatttaagccctttgttgagacctactgctcagaaaaagaaa

SEQ ID NO: 5102 - DNA, 1992 bp, Artificial Sequence
  Synthetic polypeptide
atggccaagcctcggctgctagttctctacttcgctctgattgtggttccggcctgggtgtccagcattgtcctcacagggacaagcgagcccccagatgcgcagacagtggcgcctgcggaggacgagactctgcaaaacgaggcggacaaccaggagaacgttttatctcagttgctgggggactatgacaaggtcaaggctatgtctgagggctcggactgtcagtgcaagtgtgtggtgagacccctgggccgggatgcctgccagaggatcaatgcgggggcctccaggaaggaagacttctataccgtggaaaccatcacctcaggctcgtcgtgcaagtgtgcctgtgtagcacccccatcggccctcaatccctgcgagggagacttcaggctccagaagctgcgggaggcagacagccaggacttgaagctctccacaatcatagacatgttggaaggagcgttctatggcctggatctcctgaagctacattcagtcaccaccaaactggtggggcgagtggataaactggaggaggaagtgtctaaaaacctcaccaaggaaaatgaacaaatcaaagaggacatggaagaaattcgaaccgagatgaataagcgaggcaaagaaaattgctctgaaaacatcctagatagcatgccagacatccgctcagccctgcagagggatgcagcagcagcctacgcccacccagagcagtatgaagagcggtttctgcaggaagaaaccgtgtcccagcagatcaactccatcgaacttctgcagacgcgacccctggctctgcctgaggtggtgaagtcacagcggcccctgcagaggcaggtccacctgagaggccggccggcctcccagcccactgtcatccggggcatcacctactataaagccaaggtctctgaagaagagaatgacattgaagagcagcaagatgagtttttcagcggtgacaatggagtggatttgctgattgaagatcagctcctgagacacaacggcctgatgaccagtgtcacccggaggcctgcagccacccgtcagggacacagcactgctgtgacaagcgacctgaacgctcggaccgcaccctggtcctcagcactgccacagccctcgacctcagatcccagcatcgccaaccatgcctcagtgggaccaacactccaaacaacctcggtgtctccagatcccacaagggagtcagtcctgcagccttctcctcaggtaccagccaccactgtggcccacacagccacccagcaaccagcagccccagctcctccggcagtgtctcccagggaggcattgatggaagctatgcacacagtcccagtgcctcccaccacagtcagaacagactcgctggggaaagatgctcctgctgggtggggaacaacccctgccagccccacgctgagccccgaagaagaagatgacatccggaatgtcatagaggtgaagaagctgcagaaaaaagtctgaagctaacagaggctggttcgtgagatttagagaaagaagttgtctccataatgtaaaaatgcaagtgaaatagcaagtgctaatgcagaagctgtagcaagttatctagaagatctagctaagattgttgatgaaggtggctacactaaacaacagattttcagtgtaggcaaaacagccatccattggaagaaggtgccatctaggaccttcataattaaagaggagaggtcagtgcctggcttcaaagcttcaaaggacaaggtgactcttctgttaggggctaatgcagctggtgactttaaatcaaagccagtgctcatttaccattctaaaaatcctagggcccttaagaattatgcaaatctactctcctggtgctctatacatggaacaacaaagcttggataatagcacatctttttacagcatggtttactgaataatttaagccctttgttgagacctactgctcagaaaaagaaa

SEQ ID NO: 5103 - DNA, 5286 bp, Artificial Sequence
  Synthetic polypeptide
atgagcaagagacgcatgagcgtgggtcagcaaacatgggctcttctctgcaagaactgtctcaaaaaatggagaatgaaaagacagaccttgttggaatggctcttttcatttcttctggtactgtttctgtacctatttttctccaatttacatcaagttcatgacactcctcaaatgtcttcaatggatctgggacgtgtagatagttttaatgatactaattatgttattgcatttgcacctgaatccaaaactacccaagagataatgaacaaagtggcttcagccccattcctaaaaggaagaacaatcatggggtggcctgatgaaaaaagcatggatgaattggatttgaactattcaatagacgcagtgagagtcatctttactgataccttctcctaccatttgaagttttcttggggacatagaatccccatgatgaaagagcacagagaccattcagctcactgtcaagcagtgaatgaaaaaatgaagtgtgaaggttcagagttctgggagaaaggctttgtagcttttcaagctgccattaatgctgctatcatagaaatcgcaacaaatcattcagtgatggaacagctgatgtcagttactggtgtacatatgaagatattaccttttgttgcccaaggaggagttgcaactgattttttcattttcttttgcattatttctttttctacatttatatactatgtatcagtcaatgttacacaagaaagacaatacattacgtcattgatgacaatgatgggactccgagagtcagcattctggctttcctggggtttgatgtatgctggcttcatccttatcatggccactttaatggctcttattgtaaaatctgcacaaattgtcgtcctgactggttttgtgatggtcttcaccctctttctcctctatggcctgtctttgataactttagctttcctgatgagtgtgttgataaagaaacctttccttacgggcttggttgtgtttctccttattgtcttttgggggatcctgggattcccagcattgtatacacgtcttcctgcatttttggaatggactttgtgtcttcttagcccctttgccttcactgttgggatggcccagcttatacatttggactatgatgtgaattctaatgcccacttggattcttcacaaaatccatacctcataatagctactcttttcatgttggtttttgacacccttctgtatttggtattgacattatattttgacaaaattttgcccgctgaatatggacatcgatgttctcccttgtttttcctgaaatcctgtttttggtttcaacacggaagggctaatcatgtggtccttgagaatgaaacagattctgatcctacacctaatgactgttttgaaccagtgtctccagaattctgtgggaaagaagccatcagaatcaaaaatcttaaaaaagaatatgcagggaagtgtgagagagtagaagctttgaaaggtgtggtgtttgacatatatgaaggccagatcactgccctccttggtcacagtggagctggaaaaactaccctgttaaacatacttagtgggttgtcagttccaacatcaggttcagtcactgtctataatcacacactttcaagaatggctgatatagaaaatatcagcaagttcactggattttgtccacaatccaatgtgcaatttggatttctcactgtgaaagaaaacctcaggctgtttgctaaaataaaagggattttgccacatgaagtggagaaagaggtacaacgagttgtacaggaattagaaatggaaaatattcaagacatccttgctcaaaacttaagtggtggacaaaataggaaactaacttttgggattgccattttaggagatcctcaagttttgctattggatgaaccgactgctggattggatcctctttcaaggcaccgaatatggaatctcctgaaagaggggaaatcagacagagtaattctcttcagcacccagtttatagatgaggctgacattctggcggacaggaaggtgttcatatccaatgggaagctgaagtgtgcaggctcttctctgttccttaagaagaaatggggcataggctaccatttaagtttgcatctgaatgaaaggtgtgatccagagagtataacatcactggttaagcagcacatctctgatgccaaattgacagcacaaagtgaagaaaaacttgtatatattttgcctttggaaaggacaaacaaatttccagaactttacagggatcttgatagatgttctaaccaaggcattgaggattatggtgtttccataacaactttgaatgaggtgtttctgaaattagaaggaaaatcaactattgatgaatcagatattggaatttggggacaattacaaactgatggggcaaaagatataggaagccttgttgagctggaacaagttttgtcttccttccacgaaacaaggaaaacaatcagtggcgtggcgctctggaggcagcaggtctgtgcaatagcaaaagttcgcttcctaaagttaaagaaagaaagaaaaagcctgtggactatattattgctttttggtattagctttatccctcaacttttggaacatctattctacgagtcatatcagaaaagttacccgtgggaactgtctccaaatacatacttcctctcaccaggacaacaaccacaggatcctctgacccatttactggtcatcaataagacagggtcaaccattgataactttttacattcactgaggcgacagaacatagctatagaagtggatgcctttggaactagaaatggcacagatgacccatcttacaatggtgctatcattgtgtcaggtgatgaaaaggatcacagattttcaatagcatgtaatacaaaacggctgaattgctttcctgtcctcctggatgtcattagcaatggactacttggaatttttaattcgtcagaacacattcagactgacagaagcacattttttgaagagcatatggattatgagtatgggtaccgaagtaacaccttcttctggataccgatggcagcctctttcactccatacattgcaatgagcagcattggtgactacaaaaaaaaagctcattcccagctacggatttcaggcctctacccttctgcatactggtttggccaagcactggtggatgtttccctgtactttttgatcctcctgctaatgcaaataatggattatatttttagcccagaggagattatatttataattcaaaacctgttaattcaaatcctgtgtagtattggctatgtctcatctcttgttttcttgacatatgtgatttcattcatttttcgcaatgggagaaaaaatagtggcatttggtcatttttcttcttaattgtggtcatcttctcgatagttgctactgatctaaatgaatatggatttctagggctattttttggcaccatgttaatacctcccttcacattgattggctctctattcattttttctgagatttctcctgattccatggattacttaggagcttcagaatctgaaattgtatacctggcactgctaataccttaccttcattttctcatttttcttttcattctgcgatgcctagaaatgaactgcaggaagaaactaatgagaaaggatcctgtgttcagaatttctccaagaagcaacgctatttttccaaacccagaagagcctgaaggagaggaggaagatatccagatggaaagaatgagaacagtgaatgctatggctgtgcgagactttgatgagacacccgtcatcattgccagctgtctacggaaggaatatgcaggcaaaaagaaaaattgcttttctaaaaggaagaaaaaaattgccacaagaaatgtctctttttgtgttaaaaaaggtgaagttataggactgttaggacacaatggagctggtaaaagtacaactattaagatgataactggagacacaaaaccaactgcaggacaggtgattttgaaagggagcggtggaggggaacccctgggcttcctggggtactgccctcaggagaatgcgctgtggcccaacctgacagtgaggcagcacctggaggtgtacgctgccgtgaaaggtctcaggaaaggggacgcaatgatcgccatcacacggttagtggatgcgctcaagctgcaggaccagctgaaggctcccgtgaagaccttgtcagagggaataaagcgaaagctgtgctttgtgctgagcatcctggggaacccgtcagtggtgcttctggatgagccgtcgaccgggatggaccccgaggggcagcagcaaatgtggcaggtgattcgggccacctttagaaacacggagaggggcgccctcctgaccacccactacatggcagaggctgaggcggtgtgtgaccgagtggccatcatggtgtcaggaaggctgagatgtattggttccatccaacacctgaaaagcaaatttggcaaagactacctgctggagatgaagctgaagaacctggcacaaatggagcccctccatgcagagatcctgaggcttttcccccaggctgctcagcaggaaaggttctcctccctgatggtctataagttgcctgttgaggatgtgcgacctttatcacaggctttcttcaaattagagatagttaaacagagtttcgacctggaggagtacagcctctcacagtctaccctggagcaggttttcctggagctctccaaggagcaggagctgggtgatcttgaagaggactttgatccctcgcactgtttacaatagcaaagacttggaaccaaccaaaatacccacaaatgatagaccggataaagaaaacgtgacacatatacaccatggaatactatgcagccatagaaaaggatgagttcatattcttcacagggacatggatgaagctggaaaccatcatcctcagcaaactaacacaggaacagaaaaccaaacaccgcatgttctcactcataagtgggaattgaacaatgagaatacatggacacagggaggggaacaccacaccctggggcctgttggggggatgggggctaggggagggatagcattaggagaaatacctgatgtagatgatgggttgatgggtgcagcaaagtaccatggcacatgtatacctgtgtaacaaacctgcacattcagcacatgtatcccagaacttaaagtataataaaaataaataaa

SEQ ID NO: 5104 - DNA, 5172 bp, Artificial Sequence
  Synthetic polypeptide
atgagcaagagacgcatgagcgtgggtcagcaaacatgggctcttctctgcaagaactgtctcaaaaaatggagaatgaaaagacagaccttgttggaatggctcttttcatttcttctggtactgtttctgtacctatttttctccaatttacatcaagttcatgacactcctcaaatgtcttcaatggatctgggacgtgtagatagttttaatgatactaattatgttattgcatttgcacctgaatccaaaactacccaagagataatgaacaaagtggcttcagccccattcctaaaaggaagaacaatcatggggtggcctgatgaaaaaagcatggatgaattggatttgaactattcaatagacgcagtgagagtcatctttactgataccttctcctaccatttgaagttttcttggggacatagaatccccatgatgaaagagcacagagaccattcagctcactgtcaagcagtgaatgaaaaaatgaagtgtgaaggttcagagttctgggagaaaggctttgtagcttttcaagctgccattaatgctgctatcatagaaatcgcaacaaatcattcagtgatggaacagctgatgtcagttactggtgtacatatgaagatattaccttttgttgcccaaggaggagttgcaactgattttttcattttcttttgcattatttctttttctacatttatatactatgtatcagtcaatgttacacaagaaagacaatacattacgtcattgatgacaatgatgggactccgagagtcagcattctggctttcctggggtttgatgtatgctggcttcatccttatcatggccactttaatggctcttattgtaaaatctgcacaaattgtcgtcctgactggttttgtgatggtcttcaccctctttctcctctatggcctgtctttgataactttagctttcctgatgagtgtgttgataaagaaacctttccttacgggcttggttgtgtttctccttattgtcttttgggggatcctgggattcccagcattgtatacacgtcttcctgcatttttggaatggactttgtgtcttcttagcccctttgccttcactgttgggatggcccagcttatacatttggactatgatgtgaattctaatgcccacttggattcttcacaaaatccatacctcataatagctactcttttcatgttggtttttgacacccttctgtatttggtattgacattatattttgacaaaattttgcccgctgaatatggacatcgatgttctcccttgtttttcctgaaatcctgtttttggtttcaacacggaagggctaatcatgtggtccttgagaatgaaacagattctgatcctacacctaatgactgttttgaaccagtgtctccagaattctgtgggaaagaagccatcagaatcaaaaatcttaaaaaagaatatgcagggaagtgtgagagagtagaagctttgaaaggtgtggtgtttgacatatatgaaggccagatcactgccctccttggtcacagtggagctggaaaaactaccctgttaaacatacttagtgggttgtcagttccaacatcaggttcagtcactgtctataatcacacactttcaagaatggctgatatagaaaatatcagcaagttcactggattttgtccacaatccaatgtgcaatttggatttctcactgtgaaagaaaacctcaggctgtttgctaaaataaaagggattttgccacatgaagtggagaaagaggtacaacgagttgtacaggaattagaaatggaaaatattcaagacatccttgctcaaaacttaagtggtggacaaaataggaaactaacttttgggattgccattttaggagatcctcaagttttgctattggatgaaccgactgctggattggatcctctttcaaggcaccgaatatggaatctcctgaaagaggggaaatcagacagagtaattctcttcagcacccagtttatagatgaggctgacattctggcggacaggaaggtgttcatatccaatgggaagctgaagtgtgcaggctcttctctgttccttaagaagaaatggggcataggctaccatttaagtttgcatctgaatgaaaggtgtgatccagagagtataacatcactggttaagcagcacatctctgatgccaaattgacagcacaaagtgaagaaaaacttgtatatattttgcctttggaaaggacaaacaaatttccagaactttacagggatcttgatagatgttctaaccaaggcattgaggattatggtgtttccataacaactttgaatgaggtgtttctgaaattagaaggaaaatcaactattgatgaatcagatattggaatttggggacaattacaaactgatggggcaaaagatataggaagccttgttgagctggaacaagttttgtcttccttccacgaaacaaggaaaacaatcagtggcgtggcgctctggaggcagcaggtctgtgcaatagcaaaagttcgcttcctaaagttaaagaaagaaagaaaaagcctgtggactatattattgctttttggtattagctttatccctcaacttttggaacatctattctacgagtcatatcagaaaagttacccgtgggaactgtctccaaatacatacttcctctcaccaggacaacaaccacaggatcctctgacccatttactggtcatcaataagacagggtcaaccattgataactttttacattcactgaggcgacagaacatagctatagaagtggatgcctttggaactagaaatggcacagatgacccatcttacaatggtgctatcattgtgtcaggtgatgaaaaggatcacagattttcaatagcatgtaatacaaaacggctgaattgctttcctgtcctcctggatgtcattagcaatggactacttggaatttttaattcgtcagaacacattcagactgacagaagcacattttttgaagagcatatggattatgagtatgggtaccgaagtaacaccttcttctggataccgatggcagcctctttcactccatacattgcaatgagcagcattggtgactacaaaaaaaaagctcattcccagctacggatttcaggcctctacccttctgcatactggtttggccaagcactggtggatgtttccctgtactttttgatcctcctgctaatgcaaataatggattatatttttagcccagaggagattatatttataattcaaaacctgttaattcaagtggtcatcttctcgatagttgctactgatctaaatgaatatggatttctagggctattttttggcaccatgttaatacctcccttcacattgattggctctctattcattttttctgagatttctcctgattccatggattacttaggagcttcagaatctgaaattgtatacctggcactgctaataccttaccttcattttctcatttttcttttcattctgcgatgcctagaaatgaactgcaggaagaaactaatgagaaaggatcctgtgttcagaatttctccaagaagcaacgctatttttccaaacccagaagagcctgaaggagaggaggaagatatccagatggaaagaatgagaacagtgaatgctatggctgtgcgagactttgatgagacacccgtcatcattgccagctgtctacggaaggaatatgcaggcaaaaagaaaaattgcttttctaaaaggaagaaaaaaattgccacaagaaatgtctctttttgtgttaaaaaaggtgaagttataggactgttaggacacaatggagctggtaaaagtacaactattaagatgataactggagacacaaaaccaactgcaggacaggtgattttgaaagggagcggtggaggggaacccctgggcttcctggggtactgccctcaggagaatgcgctgtggcccaacctgacagtgaggcagcacctggaggtgtacgctgccgtgaaaggtctcaggaaaggggacgcaatgatcgccatcacacggttagtggatgcgctcaagctgcaggaccagctgaaggctcccgtgaagaccttgtcagagggaataaagcgaaagctgtgctttgtgctgagcatcctggggaacccgtcagtggtgcttctggatgagccgtcgaccgggatggaccccgaggggcagcagcaaatgtggcaggtgattcgggccacctttagaaacacggagaggggcgccctcctgaccacccactacatggcagaggctgaggcggtgtgtgaccgagtggccatcatggtgtcaggaaggctgagatgtattggttccatccaacacctgaaaagcaaatttggcaaagactacctgctggagatgaagctgaagaacctggcacaaatggagcccctccatgcagagatcctgaggcttttcccccaggctgctcagcaggaaaggttctcctccctgatggtctataagttgcctgttgaggatgtgcgacctttatcacaggctttcttcaaattagagatagttaaacagagtttcgacctggaggagtacagcctctcacagtctaccctggagcaggttttcctggagctctccaaggagcaggagctgggtgatcttgaagaggactttgatccctcgcactgtttacaatagcaaagacttggaaccaaccaaaatacccacaaatgatagaccggataaagaaaacgtgacacatatacaccatggaatactatgcagccatagaaaaggatgagttcatattcttcacagggacatggatgaagctggaaaccatcatcctcagcaaactaacacaggaacagaaaaccaaacaccgcatgttctcactcataagtgggaattgaacaatgagaatacatggacacagggaggggaacaccacaccctggggcctgttggggggatgggggctaggggagggatagcattaggagaaatacctgatgtagatgatgggttgatgggtgcagcaaagtaccatggcacatgtatacctgtgtaacaaacctgcacattcagcacatgtatcccagaacttaaagtataataaaaataaataaa

SEQ ID NO: 5105 - DNA, 857 bp, Artificial Sequence; identical to SEQ ID NO: 1374
  Synthetic polypeptide

SEQ ID NO: 5106 - DNA, 890 bp, Artificial Sequence; identical to SEQ ID NO: 319
  Synthetic polypeptide

SEQ ID NO: 5107 - DNA, 947 bp, Artificial Sequence; identical to SEQ ID NO: 320
  Synthetic polypeptide

SEQ ID NO: 5108 - DNA, 475 bp, Artificial Sequence; identical to SEQ ID NO: 4531
  Synthetic polypeptide

SEQ ID NO: 5109 - DNA, 2087 bp, Artificial Sequence
  Synthetic polypeptide
atggagacttcccttagcctggagagtggccatcatgggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagtagctgagattgatctttcccaaggtatatgcacactccaaacctcattttcctctcctgtgaaatgggg

SEQ ID NO: 5110 - DNA, 2009 bp, Artificial Sequence
  Synthetic polypeptide
atggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagtagctgagattgatctttcccaaggtatatgcacactccaaacctcattttcctctcctgtgaaatgggg

SEQ ID NO: 5111 - DNA, 558 bp, Artificial Sequence; identical to SEQ ID NO: 2797
  Synthetic polypeptide

SEQ ID NO: 5112 - DNA, 916 bp, Artificial Sequence; identical to SEQ ID NO: 1226
  Synthetic polypeptide

SEQ ID NO: 5113 - DNA, 1284 bp, Artificial Sequence; identical to SEQ ID NO: 2536
  Synthetic polypeptide

SEQ ID NO: 5114 - DNA, 792 bp, Artificial Sequence; identical to SEQ ID NO: 4298
  Synthetic polypeptide

SEQ ID NO: 5115 - DNA, 1491 bp, Artificial Sequence; identical to SEQ ID NO: 1314
  Synthetic polypeptide

SEQ ID NO: 5116 - DNA, 3693 bp, Artificial Sequence; identical to SEQ ID NO: 1315
  Synthetic polypeptide

SEQ ID NO: 5117 - DNA, 570 bp, Artificial Sequence
  Synthetic polypeptide
atgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagttaacccttgaacagaatgggtttgaactgcgcagcttcacttaaatgcatggattttcttctgcctccaccacctctgagacagcaagatcagcccctcctcctctcagcctactcaatgcaaagaagacaaggatgaagacctttatgatgatccacttccacttaatgaatagtaaatatattttctcttcttatgattttctt

SEQ ID NO: 5118 - DNA, 203 bp, Artificial Sequence
  Synthetic polypeptide
atggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttgggagtggggacctctggatcccagtgaagagcttcgactccaagaaaatgtgcatcaaccc

SEQ ID NO: 5119 - DNA, 639 bp, Artificial Sequence; identical to SEQ ID NO: 1196
  Synthetic polypeptide

SEQ ID NO: 5120 - DNA, 500 bp, Artificial Sequence; identical to SEQ ID NO: 1197
  Synthetic polypeptide

SEQ ID NO: 5121 - DNA, 1346 bp, Artificial Sequence; identical to SEQ ID NO: 1198
  Synthetic polypeptide

SEQ ID NO: 5122 - DNA, 901 bp, Artificial Sequence; identical to SEQ ID NO: 1199
  Synthetic polypeptide

SEQ ID NO: 5123 - DNA, 449 bp, Artificial Sequence
  Synthetic polypeptide
ggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtgtggtggcgcactcctgtagtcccaggtactcaggaggctgaggtaggagaattgtttgaactccggaggcagaggttgcagtgaaccgagatcacgtactccagcctggtcaacagagcgagactccgtcttaaaaaaaaagaa

SEQ ID NO: 5124 - DNA, 1161 bp, Artificial Sequence
  Synthetic polypeptide
atgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtgtggtggcgcactcctgtagtcccaggtactcaggaggctgaggtaggagaattgtttgaactccggaggcagaggttgcagtgaaccgagatcacgtactccagcctggtcaacagagcgagactccgtcttaaaaaaaaagaa

SEQ ID NO: 5125 - DNA, 2849 bp, Artificial Sequence; identical to SEQ ID NO: 1326
  Synthetic polypeptide

SEQ ID NO: 5126 - DNA, 1925 bp, Artificial Sequence; identical to SEQ ID NO: 1327
  Synthetic polypeptide

SEQ ID NO: 5127 - DNA, 2729 bp, Artificial Sequence; identical to SEQ ID NO: 1328
  Synthetic polypeptide

SEQ ID NO: 5128 - DNA, 2549 bp, Artificial Sequence; identical to SEQ ID NO: 1329
  Synthetic polypeptide

SEQ ID NO: 5129 - DNA, 266 bp, Artificial Sequence
  Synthetic polypeptide
atgaccgaagaagtggatttcctgggacaggactctgatgggggtagtgaggaagtggtcctaactcctgcagagctcattgaaagattggagcagccggatgtggtggcgcatgcctgtaatcccagctactcgggaggctaaggccggaggatcacctgaacctgggaggcagaggttgtggtgagccaagatcctacccaccattgcactccagcctgggcaacaagagtgaaactccgtctcaaaaaaataataaaataaaa

SEQ ID NO: 5130 - DNA, 770 bp, Artificial Sequence; identical to SEQ ID NO: 3389
  Synthetic polypeptide

SEQ ID NO: 5131 - DNA, 1110 bp, Artificial Sequence
  Synthetic polypeptide
cacttgcagagggacgatgcgggacggtaccagtgcctggcagagaatgagatgggcgtggcgaagaaagtggtgatcctcgtcctgcagagtgctccggtgttccaggtggagccccaggacatgacagtgagatctggggatgacgtggccctgcggtgccaggccactggagagcccacacccaccattgaatggctacaggcgggtcaacccttgcgggccagccggcggctccggaccctgcccgatgggagcctgtggctggagaacgtggagactggggatgcaggcacctacgactgcgtcgctcacaacctcctgggctctgccacagcccgggcgttcctggtcgtgagaggggagccccaggggagctggggcagcatgactggggtgataaatggccggaaatttggcgtggccacactcaacaccagcgtgatgcaggaggcacactccggggtcagcagcatccacagcagcatccgccatgtcccagcaaacgtggggcctctgatgcgggtgctcgtggtcaccatcgcccccatctactgggccctggccagagagagtggggaagccctgaatggccactctctgactgggggcaggttccggcaggagtcacacgtggagtttgctacaggggagctgctcacgatgacccaggtggcccggggtctggatcccgatggcctcctgctcctcgacgtggtggtcaatggcgttgtccccgagagcctggctgacgcagatcttcaagtgcaggactttgaggagcactacgtgcaaacagggcctggccagctgttcgtgggctccacacagcgcttcttccagggcggcctcccctcgttcctacgctgcaaccacagcatccagtacaacgcggcccggggcccccagccccagctggtgcagcacctgcgggcctcagctatcagctcggcctttgatccagaggccgaggccctgcgcttccagctcgctacagccctgcaggcggctcatcagctatccttagtgttggtgtattttatgtgtgacccaaggcaattcttcttcttccagcgtggcccacagaagccgaaagataggacacccctg

SEQ ID NO: 5132 - DNA, 1068 bp, Artificial Sequence; identical to SEQ ID NO: 1221
  Synthetic polypeptide

SEQ ID NO: 5133 - DNA, 344 bp, Artificial Sequence
  Synthetic polypeptide
atgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggttgtggtggcttgtgcctgtggtcccagctactcaggaggcaggggtgagagaatttcttgagccctgaaggacgaggctgcagtgagccatgattataccactgcactccagcttgggcaacagagcaagacctggtttcagaaaaaaaagaaaaaggaaa

SEQ ID NO: 5134 - DNA, 473 bp, Artificial Sequence; identical to SEQ ID NO: 1130
  Synthetic polypeptide

SEQ ID NO: 5135 - DNA, 840 bp, Artificial Sequence
  Synthetic polypeptide
atgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagcgccatggctacttattctgccacatgtgccaacaatagccctgcacagggcatcaacatggccaacagcattgccaacctgagactgaaggccaaggaatatagtttacagaggaaccagccatgcttttgtaacttgccaggtggacttgaccaactacattaccatgctgtgcctcagtttacccatttgtaaaatgggattaataatacttacctacctcacaggggtgttgtgagg

SEQ ID NO: 5136 - DNA, 128 bp, Artificial Sequence; identical to SEQ ID NO: 144
  Synthetic polypeptide

SEQ ID NO: 5137 - DNA, 1259 bp, Artificial Sequence; identical to SEQ ID NO: 3871
  Synthetic polypeptide

SEQ ID NO: 5138 - DNA, 721 bp, Artificial Sequence; identical to SEQ ID NO: 414
  Synthetic polypeptide

SEQ ID NO: 5139 - DNA, 610 bp, Artificial Sequence; identical to SEQ ID NO: 163
  Synthetic polypeptide

SEQ ID NO: 5140 - DNA, 800 bp, Artificial Sequence
  Synthetic polypeptide
atgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaagaaatacaaaattagctgggcatggtggtgcatgcctgtaatcccagctacttgggaggctgaggcaggagaaacgcttgaacccatgaggcagaggttgtagtgagccgagatcacaccattgcactccagcctgggcgacagagtgagactccatctcaaaaaaaaaaagaaaggaaaaaa

SEQ ID NO: 5141 - DNA, 641 bp, Artificial Sequence
  Synthetic polypeptide
atgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaagaaatacaaaattagctgggcatggtggtgcatgcctgtaatcccagctacttgggaggctgaggcaggagaaacgcttgaacccatgaggcagaggttgtagtgagccgagatcacaccattgcactccagcctgggcgacagagtgagactccatctcaaaaaaaaaaagaaaggaaaaaa

SEQ ID NO: 5142 - DNA, 118 bp, Artificial Sequence; identical to SEQ ID NO: 4271
  Synthetic polypeptide

SEQ ID NO: 5143 - DNA, 603 bp, Artificial Sequence; identical to SEQ ID NO: 2748
  Synthetic polypeptide

SEQ ID NO: 5144 - DNA, 1479 bp, Artificial Sequence
  Synthetic polypeptide
atgagtgggggccgcttcgactttgatgatggaggggcgtactgcgggggctgggaggggggaaaggcccatgggcatggactgtgcacaggccccaagggccagggcgaatactctggctcctggaactttggctttgaggtggcaggtgtctacacctggcccagcggaaacacctttgagggatactggagccagggcaaacggcatgggctgggcatagagaccaaggggcgctggctctacaagggcgagtggacacatggcttcaagggacgctacggaatccggcagagctcaagcagcggtgccaagtatgagggcacctggaacaatggcctgcaagacggctatggcaccgagacctatgctgatggagggacgtaccaaggccagttcaccaacggcatgcgccatggctacggagtacgccagagcgtgccctacgggatggccgtggtggtgcgctcgccgctgcgcacgtcgctgtcgtccctgcgcagcgagcacagcaacggcacggtggccccggactctcccgcctcgccggcctccgacggccccgcgctgccctcgcccgccatcccgcgtggcggcttcgcgctcagcctcctggccaatgccgaggcggccgcgcgggcgcccaagggcggcggcctcttccagcggggcgcgctgctgggcaagctgcggcgcgcagagtcgcgcacgtccgtgggtagccagcgcagccgtgtcagcttccttaagagcgacctcagctcgggcgccagcgacgccgcgtccaccgccagcctgggagaggccgccgagggcgccgacgaggccgcacccttcgaggccgatatcgacgccaccaccaccgagacctacatgggcgagtggaagaacgacaaacgctcgggcttcggcgtgagcgaacgctccagtggcctccgctacgagggcgagtggctggacaacctgcgccacggctatggctgcaccacgctgcccgacggccaccgcgaggagggcaagtaccgccacaacgtgctggtcaaggacaccaagcgccgcatgctgcagctcaagagcaacaaggtccgccagaaagtggagcacagtgtggagggtgcccagcgcgccgctgctatcgcgcgccagaaggccgagattgccgcctccaggtgggcagtggggagcccggaaccagcttgtgcccagagaaagagttaagctgctgaccctgaaggcaagggagagccggcagcacagcggtgtatgggagcagcccactcaagcagctaaaacagggcggacggtgtgagaaaactactgatgagagaagagtgtgtaagagctgttgatgagagagctgctgaataaaactacatttcacctgcctatggcacccgcccagtgtttttcacctatctgcccatccgcccactccccttggacctcagtatgggcccgaacctgaccccaagcaggaca

SEQ ID NO: 5145 - DNA, 456 bp, Artificial Sequence
  Synthetic polypeptide
atgatcttagctctctgcaacttccgcctcctgggctcaagcgattctcctgtctcaggctccggagtagctgggactacaggcatgcgccacaacaccagggaaaaaaacaaaccaaccaacaaactgagcctgaaactgataacacagatacgtacagcatcatatttaagtaaccaatcggaattattgcagtggagatgttttattggactggtgtcctcatcagaagaggaagagacatcagaagcaggtctgcacagaggagaagccatgctgggatacaatgagagggcatctgtcagcaagccaaggagagaagcctcaggagaaaccacagctatcgacaccttgattttagacttccaacctccagaaatgtgagaaatacatttatgttgttttagccacccactctgtgataccgtgttatggcagccctagaagactaatata

SEQ ID NO: 5146 - DNA, 1649 bp, Artificial Sequence; identical to SEQ ID NO: 2810
  Synthetic polypeptide

SEQ ID NO: 5147 - DNA, 1508 bp, Artificial Sequence; identical to SEQ ID NO: 2811
  Synthetic polypeptide

SEQ ID NO: 5148 - DNA, 782 bp, Artificial Sequence; identical to SEQ ID NO: 2812
  Synthetic polypeptide

SEQ ID NO: 5149 - DNA, 1504 bp, Artificial Sequence; identical to SEQ ID NO: 2813
  Synthetic polypeptide

SEQ ID NO: 5150 - DNA, 1007 bp, Artificial Sequence; identical to SEQ ID NO: 2814
  Synthetic polypeptide

SEQ ID NO: 5151 - DNA, 1412 bp, Artificial Sequence
  Synthetic polypeptide
atgctcctggctgttttgtactgcctgctgtggagtttccagacctccgctggccatttccctagagcctgtgtctcctctaagaacctgatggagaaggaatgctgtccaccgtggagcggggacaggagtccctgtggccagctttcaggcagaggttcctgtcagaatatccttctgtccaatgcaccacttgggcctcaatttcccttcacaggggtggatgaccgggagtcgtggccttccgtcttttataataggacctgccagtgctctggcaacttcatgggattcaactgtggaaactgcaagtttggcttttggggaccaaactgcacagagagacgactcttggtgagaagaaacatcttcgatttgagtgccccagagaaggacaaattttttgcctacctcactttagcaaagcataccatcagctcagactatgtcatccccatagggacctatggccaaatgaaaaatggatcaacacccatgtttaacgacatcaatatttatgacctctttgtctggatgcattattatgtgtcaatggatgcactgcttgggggatctgaaatctggagagacattgattttgcccatgaagcaccagcttttctgccttggcatagactcttcttgttgcggtgggaacaagaaatccagaagctgacaggagatgaaaacttcactattccatattgggactggcgggatgcagaaaagtgtgacatttgcacagatgagtacatgggaggtcagcaccccacaaatcctaacttactcagcccagcatcattcttctcctcttggcagattgtctgtagccgattggaggagtacaacagccatcagtctttatgcaatggaacgcccgagggacctttacggcgtaatcctggaaaccatgacaaatccagaaccccaaggctcccctcttcagctgatgtagaattttgcctgagtttgacccaatatgaatctggttccatggataaagctgccaatttcagctttagaaatacactggaaggatttgctagtccacttactgggatagcggatgcctctcaaagcagcatgcacaatgccttgcacatctatatgaatggaacaatgtcccaggtacagggatctgccaacgatcctatcttccttcttcaccatgcatttgttgacagatgtgacctgcctcaggaagaaatgtctgcctcatacacttaaatttaccctcgtatgtactcttgtctaccctgtggatcctcctcatgctgtactctgcttacttgcctgttttcttaacagtgttcaccattagttctgcattgatcatatctagtttgttcatagttttattgctaggacctaacaaaatgtcaagaaatacgatatgtgtctgataaatattt

SEQ ID NO: 5152 - DNA, 434 bp, Artificial Sequence; identical to SEQ ID NO: 992
  Synthetic polypeptide

SEQ ID NO: 5153 - DNA, 860 bp, Artificial Sequence; identical to SEQ ID NO: 2285
  Synthetic polypeptide

SEQ ID NO: 5154 - DNA, 1823 bp, Artificial Sequence; identical to SEQ ID NO: 2286
  Synthetic polypeptide

SEQ ID NO: 5155 - DNA, 1796 bp, Artificial Sequence; identical to SEQ ID NO: 2287
  Synthetic polypeptide

SEQ ID NO: 5156 - DNA, 67 bp, Artificial Sequence
  Synthetic polypeptide
atgttagcaaggaacatttgaaaaggaaattggaaaaataattccatttaccatagcatttaagaga

SEQ ID NO: 5157 - DNA, 1486 bp, Artificial Sequence
  Synthetic polypeptide
atgctcctggctgttttgtactgcctgctgtggagtttccagacctccgctggccatttccctagagcctgtgtctcctctaagaacctgatggagaaggaatgctgtccaccgtggagcggggacaggagtccctgtggccagctttcaggcagaggttcctgtcagaatatccttctgtccaatgcaccacttgggcctcaatttcccttcacaggggtggatgaccgggagtcgtggccttccgtcttttataataggacctgccagtgctctggcaacttcatgggattcaactgtggaaactgcaagtttggcttttggggaccaaactgcacagagagacgactcttggtgagaagaaacatcttcgatttgagtgccccagagaaggacaaattttttgcctacctcactttagcaaagcataccatcagctcagactatgtcatccccatagggacctatggccaaatgaaaaatggatcaacacccatgtttaacgacatcaatatttatgacctctttgtctggatgcattattatgtgtcaatggatgcactgcttgggggatctgaaatctggagagacattgattttgcccatgaagcaccagcttttctgccttggcatagactcttcttgttgcggtgggaacaagaaatccagaagctgacaggagatgaaaacttcactattccatattgggactggcgggatgcagaaaagtgtgacatttgcacagatgagtacatgggaggtcagcaccccacaaatcctaacttactcagcccagcatcattcttctcctcttggcagattgtctgtagccgattggaggagtacaacagccatcagtctttatgcaatggaacgcccgagggacctttacggcgtaatcctggaaaccatgacaaatccagaaccccaaggctcccctcttcagctgatgtagaattttgcctgagtttgacccaatatgaatctggttccatggataaagctgccaatttcagctttagaaatacactggaaggatttgctagtccacttactgggatagcggatgcctctcaaagcagcatgcacaatgccttgcacatctatatgaatggaacaatgtcccaggtacagggatctgccaacgatcctatcttccttcttcaccatgcatttgttgacagtatttttgagcagtggctccgaaggcaccgtcctcttcaagaagtttatccagaagccaatgcacccattggacataaccgggaatcctacatggttccttttataccactgtacagaaatggtgatttctttatttcatccaaagatctgggctatgactatagctatctacaagattcagtgggacagtcttctggggtgcattccctgacttcacagagatgtaggaagtcttttctccatgatgcctttctatcttcatcagaacaacattactctcgaaatgatttgtttacctgcc

SEQ ID NO: 5158 - DNA, 1398 bp, Artificial Sequence; identical to SEQ ID NO: 948
  Synthetic polypeptide

SEQ ID NO: 5159 - DNA, 1302 bp, Artificial Sequence; identical to SEQ ID NO: 949
  Synthetic polypeptide

SEQ ID NO: 5160 - DNA, 575 bp, Artificial Sequence
  Synthetic polypeptide
atgttccagaacctgcaaggaacatttgaaaaggaaattggaaaaataattccatttaccatagcatttaagagagctgaggctgtggagccagatggctgcgttcagagctggcgctgctgtttaccatgtgaccttggacaagcttctcgcttcattcataccacagtttgttcggctattaggtggaggagctgtaagggggagaggaactttgctgaaaggcacatcctccctgcagagcttgaagaacaatctaaccatgctggcatggggcccatcctacctgcaatgccaaggaactgactcagcacaagaagacagcttcgactccctatgatttcatctctgaccaatcagcactcctggcacactggcttcccccaacccaccaagttatccttaaaaactccattccctgattgctaggggagacagatttgagtaataataaaactccggtctcccccacagctggctctgcacgaattactcttcttctattgcaattcccctgtcttgatgaatcggctctgtctaggcagcaggcaaggtgaaccctttgagcagttaca

SEQ ID NO: 5161 - DNA, 875 bp, Artificial Sequence
  Synthetic polypeptide
atgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagtccttcccgcctgcacagctcccagactcgcccgccgccccgaagctgttcggcctcctttctagcccgctttccagcctcgcaaggttcttctctcaccttctccggcgaccccctcccgaggctccccggaggcgcctggacttctcccccctgcttcccgccctgccggccgcccggctctcgagggggcacgaggagctgccgggccgcctctcgctcctgctcggggcggcgctggcactgcccggccgaccctcggggggtcgtccgctgaggcccccccatccggtagccaagcccagggaagaagacgccaccgctgggcagagctcgcctatgccgggtctttgcatgcaccaccacatctggctaatcaagtgaagatgaggccaaactggatgaaggcgggcctgaaatccaacgactggtgaccttataaggagggagagcttcaaagacccaggcagtcatagagggaagaagggcaagtggcaaagaagacagagattgggtttctgttgccaccgaggctgccagaagaggcaaggaagaatcctcccctagagccttcagaggcagatgcctggccctgctgacggtttggttttgaacttttagcctccagaactgtgcaagaataaatttctgttgttttaagccatcgggtttgtggtaatttgttatggcagctctaggaaactaatcca

SEQ ID NO: 5162 - DNA, 499 bp, Artificial Sequence; identical to SEQ ID NO: 2210
  Synthetic polypeptide

SEQ ID NO: 5163 - DNA, 1141 bp, Artificial Sequence; identical to SEQ ID NO: 1825
  Synthetic polypeptide

SEQ ID NO: 5164 - DNA, 1110 bp, Artificial Sequence
  Synthetic polypeptide
atgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggctcagtgctgcggtgggaagattgctggagcccaggagttcgaggctgcggtgagccatgatcacaccactgtactccagcaacacagcgaaaccctgtctc

SEQ ID NO: 5165 - DNA, 1026 bp, Artificial Sequence
  Synthetic polypeptide
atgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggctcagtgctgcggtgggaagattgctggagcccaggagttcgaggctgcggtgagccatgatcacaccactgtactccagcaacacagcgaaaccctgtctc

SEQ ID NO: 5166 - DNA, 822 bp, Artificial Sequence
  Synthetic polypeptide
atggcagaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggctcagtgctgcggtgggaagattgctggagcccaggagttcgaggctgcggtgagccatgatcacaccactgtactccagcaacacagcgaaaccctgtctc

SEQ ID NO: 5167 - DNA, 668 bp, Artificial Sequence
  Synthetic polypeptide
atggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggtgcagtggctcactcctgtaatcccagcactttgggaggctgaggcgggtggatcatctgaggtcaggagttcaagaccagcctggccaacatggtgaaatcccttctctactaaaaaaaatacaaaaattagctggatggtggtgcgcgcctgtaatcccagccactcaggaggctgaggcaggagaattgcctgaacccaggaggcagaggttgcagtgagccaagatcacaccattgcactccagcctgggtgacaaagtgagactctaccaaaaaacaaacaaaaaaccctaaaaaacaaaa

SEQ ID NO: 5168 - DNA, 707 bp, Artificial Sequence
  Synthetic polypeptide
atggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctggaaggctgggatgcatgggagaccttttttctactccagactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggtgcagtggctcactcctgtaatcccagcactttgggaggctgaggcgggtggatcatctgaggtcaggagttcaagaccagcctggccaacatggtgaaatcccttctctactaaaaaaaatacaaaaattagctggatggtggtgcgcgcctgtaatcccagccactcaggaggctgaggcaggagaattgcctgaacccaggaggcagaggttgcagtgagccaagatcacaccattgcactccagcctgggtgacaaagtgagactctaccaaaaaacaaacaaaaaaccctaaaaaacaaaa

SEQ ID NO: 5169 - DNA, 509 bp, Artificial Sequence
  Synthetic polypeptide
atgggagaccttttttctactccagactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggtgcagtggctcactcctgtaatcccagcactttgggaggctgaggcgggtggatcatctgaggtcaggagttcaagaccagcctggccaacatggtgaaatcccttctctactaaaaaaaatacaaaaattagctggatggtggtgcgcgcctgtaatcccagccactcaggaggctgaggcaggagaattgcctgaacccaggaggcagaggttgcagtgagccaagatcacaccattgcactccagcctgggtgacaaagtgagactctaccaaaaaacaaacaaaaaaccctaaaaaacaaaa

SEQ ID NO: 5170 - DNA, 890 bp, Artificial Sequence; identical to SEQ ID NO: 319
  Synthetic polypeptide

SEQ ID NO: 5171 - DNA, 947 bp, Artificial Sequence; identical to SEQ ID NO: 320
  Synthetic polypeptide

SEQ ID NO: 5172 - DNA, 1146 bp, Artificial Sequence; identical to SEQ ID NO: 988
  Synthetic polypeptide

SEQ ID NO: 5173 - DNA, 354 bp, Artificial Sequence
  Synthetic polypeptide
atgcggggtccgagcggggctctgtggctgctcctggctctgcgcaccgtgctcggtggcatggaggtgcggtggtgcgccacctcggacccagagcagcacaagtgcggcaacatgagcgaggccttccgggaagcgggcatccagccctccctcctctgcgtccggggcacctccgccgaccactgcgtccagctcatcgcggcccaggaggctgacgccatcactctggatggaggagccatctatgaggcgggaaaggagcacggcctgaagccggtggtgggcgaagtgtacgatcaagactgtataatggggatagtaacacctgcgctgtcacccagactaaatgag

SEQ ID NO: 5174 - DNA, 785 bp, Artificial Sequence
  Synthetic polypeptide
atgcggcccctgctgctactggccctgctgggctggctgctgctggccgaagcgaagggcgacgccaagccggaggccccctgttgccaagagggcctcagagctggtggctctggttctcttcacctggggagagacttcaccgtcctggcaggagctcgggggagcccttccccaagtgtgagcagcatccctcgtttctggatcccaggttcagacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggtctccagtgcagaatgtcctgaatagagctcctgacttttcaaccccaaatgtgctcccctgcagttctgatctcattcaacagacacgcagccccatagacagaacccaggagtcactcctgactcctcccttgccctcctccacctacgtccaatgccagtcacctgtctactac

SEQ ID NO: 5175 - DNA, 644 bp, Artificial Sequence
  Synthetic polypeptide
atgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggtctccagtgcagaatgtcctgaatagagctcctgacttttcaaccccaaatgtgctcccctgcagttctgatctcattcaacagacacgcagccccatagacagaacccaggagtcactcctgactcctcccttgccctcctccacctacgtccaatgccagtcacctgtctactac

SEQ ID NO: 5176 - DNA, 2466 bp, Artificial Sequence; identical to SEQ ID NO: 1682
  Synthetic polypeptide

SEQ ID NO: 5177 - DNA, 1806 bp, Artificial Sequence; identical to SEQ ID NO: 1683
  Synthetic polypeptide

SEQ ID NO: 5178 - DNA, 2412 bp, Artificial Sequence; identical to SEQ ID NO: 1684
  Synthetic polypeptide

SEQ ID NO: 5179 - DNA, 2211 bp, Artificial Sequence; identical to SEQ ID NO: 1685
  Synthetic polypeptide

SEQ ID NO: 5180 - DNA, 364 bp, Artificial Sequence; identical to SEQ ID NO: 1686
  Synthetic polypeptide

SEQ ID NO: 5181 - DNA, 39 bp, Artificial Sequence; identical to SEQ ID NO: 2401
  Synthetic polypeptide

SEQ ID NO: 5182 - DNA, 483 bp, Artificial Sequence; identical to SEQ ID NO: 2246
  Synthetic polypeptide

SEQ ID NO: 5183 - DNA, 1356 bp, Artificial Sequence
  Synthetic polypeptide
atgctcctggctgttttgtactgcctgctgtggagtttccagacctccgctggccatttccctagagcctgtgtctcctctaagaacctgatggagaaggaatgctgtccaccgtggagcggggacaggagtccctgtggccagctttcaggcagaggttcctgtcagaatatccttctgtccaatgcaccacttgggcctcaatttcccttcacaggggtggatgaccgggagtcgtggccttccgtcttttataataggacctgccagtgctctggcaacttcatgggattcaactgtggaaactgcaagtttggcttttggggaccaaactgcacagagagacgactcttggtgagaagaaacatcttcgatttgagtgccccagagaaggacaaattttttgcctacctcactttagcaaagcataccatcagctcagactatgtcatccccatagggacctatggccaaatgaaaaatggatcaacacccatgtttaacgacatcaatatttatgacctctttgtctggatgcattattatgtgtcaatggatgcactgcttgggggatctgaaatctggagagacattgattttgcccatgaagcaccagcttttctgccttggcatagactcttcttgttgcggtgggaacaagaaatccagaagctgacaggagatgaaaacttcactattccatattgggactggcgggatgcagaaaagtgtgacatttgcacagatgagtacatgggaggtcagcaccccacaaatcctaacttactcagcccagcatcattcttctcctcttggcagattgtctgtagccgattggaggagtacaacagccatcagtctttatgcaatggaacgcccgagggacctttacggcgtaatcctggaaaccatgacaaatccagaaccccaaggctcccctcttcagctgatgtagaattttgcctgagtttgacccaatatgaatctggttccatggataaagctgccaatttcagctttagaaatacactggaaggatttgctagtccacttactgggatagcggatgcctctcaaagcagcatgcacaatgccttgcacatctatatgaatggaacaatgtcccagatgtgacctgcctcaggaagaaatgtctgcctcatacacttaaatttaccctcgtatgtactcttgtctaccctgtggatcctcctcatgctgtactctgcttacttgcctgttttcttaacagtgttcaccattagttctgcattgatcatatctagtttgttcatagttttattgctaggacctaacaaaatgtcaagaaatacgatatgtgtctgataaatattt

SEQ ID NO: 5184 - DNA, 139 bp, Artificial Sequence
  Synthetic polypeptide
ccaacttctggggcgccctgagccccgatgagtactacgcccgctccgaggactacgtggagctggtgcagcggaagcgagtcctgggtgacagagcaagactccgtctcaaaaaccaaaaacaagaaacaaaaaagaa

SEQ ID NO: 5185 - DNA, 1415 bp, Artificial Sequence
  Synthetic polypeptide
atgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtcctgggtgacagagcaagactccgtctcaaaaaccaaaaacaagaaacaaaaaagaa

SEQ ID NO: 5186 - DNA, 253 bp, Artificial Sequence
  Synthetic polypeptide
acttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtcctgggtgacagagcaagactccgtctcaaaaaccaaaaacaagaaacaaaaaagaa

SEQ ID NO: 5187 - DNA, 787 bp, Artificial Sequence
  Synthetic polypeptide
gattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcaggaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtcctgggtgacagagcaagactccgtctcaaaaaccaaaaacaagaaacaaaaaagaa

SEQ ID NO: 5188 - DNA, 1052 bp, Artificial Sequence; identical to SEQ ID NO: 247
  Synthetic polypeptide

SEQ ID NO: 5189 - DNA, 327 bp, Artificial Sequence; identical to SEQ ID NO: 246
  Synthetic polypeptide

SEQ ID NO: 5190 - DNA, 767 bp, Artificial Sequence; identical to SEQ ID NO: 937
  Synthetic polypeptide

SEQ ID NO: 5191 - DNA, 677 bp, Artificial Sequence; identical to SEQ ID NO: 938
  Synthetic polypeptide

SEQ ID NO: 5192 - DNA, 454 bp, Artificial Sequence; identical to SEQ ID NO: 2297
  Synthetic polypeptide

SEQ ID NO: 5193 - DNA, 980 bp, Artificial Sequence; identical to SEQ ID NO: 139
  Synthetic polypeptide

SEQ ID NO: 5194 - DNA, 1256 bp, Artificial Sequence; identical to SEQ ID NO: 140
  Synthetic polypeptide

SEQ ID NO: 5195 - DNA, 1277 bp, Artificial Sequence; identical to SEQ ID NO: 142
  Synthetic polypeptide

SEQ ID NO: 5196 - DNA, 534 bp, Artificial Sequence; identical to SEQ ID NO: 2415
  Synthetic polypeptide

SEQ ID NO: 5197 - DNA, 542 bp, Artificial Sequence; identical to SEQ ID NO: 2416
  Synthetic polypeptide

SEQ ID NO: 5198 - DNA, 1403 bp, Artificial Sequence; identical to SEQ ID NO: 2417
  Synthetic polypeptide

SEQ ID NO: 5199 - DNA, 491 bp, Artificial Sequence; identical to SEQ ID NO: 2418
  Synthetic polypeptide

SEQ ID NO: 5200 - DNA, 578 bp, Artificial Sequence; identical to SEQ ID NO: 2419
  Synthetic polypeptide

SEQ ID NO: 5201 - DNA, 1280 bp, Artificial Sequence; identical to SEQ ID NO: 2420
  Synthetic polypeptide

SEQ ID NO: 5202 - DNA, 1370 bp, Artificial Sequence; identical to SEQ ID NO: 2421
  Synthetic polypeptide

SEQ ID NO: 5203 - DNA, 692 bp, Artificial Sequence; identical to SEQ ID NO: 2422
  Synthetic polypeptide

SEQ ID NO: 5204 - DNA, 431 bp, Artificial Sequence; identical to SEQ ID NO: 2423
  Synthetic polypeptide

SEQ ID NO: 5205 - DNA, 344 bp, Artificial Sequence; identical to SEQ ID NO: 2424
  Synthetic polypeptide

SEQ ID NO: 5206 - DNA, 1553 bp, Artificial Sequence; identical to SEQ ID NO: 2425
  Synthetic polypeptide

SEQ ID NO: 5207 - DNA, 1493 bp, Artificial Sequence; identical to SEQ ID NO: 2426
  Synthetic polypeptide

SEQ ID NO: 5208 - DNA, 638 bp, Artificial Sequence; identical to SEQ ID NO: 2427
  Synthetic polypeptide

SEQ ID NO: 5209 - DNA, 1439 bp, Artificial Sequence; identical to SEQ ID NO: 2428
  Synthetic polypeptide

SEQ ID NO: 5210 - DNA, 1352 bp, Artificial Sequence; identical to SEQ ID NO: 2429
  Synthetic polypeptide

SEQ ID NO: 5211 - DNA, 602 bp, Artificial Sequence; identical to SEQ ID NO: 2430
  Synthetic polypeptide

SEQ ID NO: 5212 - DNA, 1050 bp, Artificial Sequence
  Synthetic polypeptide
atgctcctggctgttttgtactgcctgctgtggagtttccagacctccgctggccatttccctagagcctgtgtctcctctaagaacctgatggagaaggaatgctgtccaccgtggagcggggacaggagtccctgtggccagctttcaggcagaggttcctgtcagaatatccttctgtccaatgcaccacttgggcctcaatttcccttcacaggggtggatgaccgggagtcgtggccttccgtcttttataataggacctgccagtgctctggcaacttcatgggattcaactgtggaaactgcaagtttggcttttggggaccaaactgcacagagagacgactcttggtgagaagaaacatcttcgatttgagtgccccagagaaggacaaattttttgcctacctcactttagcaaagcataccatcagctcagactatgtcatccccatagggacctatggccaaatgaaaaatggatcaacacccatgtttaacgacatcaatatttatgacctctttgtctggatgcattattatgtgtcaatggatgcactgcttgggggatctgaaatctggagagacattgattttgcccatgaagcaccagcttttctgccttggcatagactcttcttgttgcggtgggaacaagaaatccagaagctgacaggagatgaaaacttcactattccatattgggactggcgggatgcagaaaagtgtgacatttgcacagatgagtacatgggaggtcagcaccccacaaatcctaacttactcagcccagcatcattcttctcctcttggcagattgtctgtagccgattggaggagtacaacagccatcagtctttatgcaatggaacgcccgagggacctttacggcgtaatcctggaaaccatgacaaatccagaaccccaaggctcccctcttcagctgatgtagaattttgcctgagtttgacccaatatgaatctggttccatggataaagctgccaatttcagctttagaaatacactggaagagttactacgaaga

SEQ ID NO: 5213 - DNA, 1030 bp, Artificial Sequence; identical to SEQ ID NO: 2232
  Synthetic polypeptide

SEQ ID NO: 5214 - DNA, 1204 bp, Artificial Sequence; identical to SEQ ID NO: 2233
  Synthetic polypeptide

SEQ ID NO: 5215 - DNA, 1692 bp, Artificial Sequence
  Synthetic polypeptide
atgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgccccccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtatt

SEQ ID NO: 5216 - DNA, 1665 bp, Artificial Sequence
  Synthetic polypeptide
atgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgccccccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtatt

SEQ ID NO: 5217 - DNA, 729 bp, Artificial Sequence
  Synthetic polypeptide
ctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgccccccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtatt

SEQ ID NO: 5218 - DNA, 1074 bp, Artificial Sequence
  Synthetic polypeptide
ctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacaacagcggagcgttcgtgtacggctccatgagcttcttggataaggtggccaatgggctggcagtcatggccatccagagcctgcacccttgccccccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtatt

SEQ ID NO: 5219 - DNA, 276 bp, Artificial Sequence; identical to SEQ ID NO: 923
  Synthetic polypeptide

SEQ ID NO: 5220 - DNA, 504 bp, Artificial Sequence; identical to SEQ ID NO: 1893
  Synthetic polypeptide

SEQ ID NO: 5221 - DNA, 801 bp, Artificial Sequence; identical to SEQ ID NO: 1894
  Synthetic polypeptide

SEQ ID NO: 5222 - DNA, 438 bp, Artificial Sequence; identical to SEQ ID NO: 1895
  Synthetic polypeptide

SEQ ID NO: 5223 - DNA, 145 bp, Artificial Sequence; identical to SEQ ID NO: 1896
  Synthetic polypeptide

SEQ ID NO: 5224 - DNA, 2497 bp, Artificial Sequence
  Synthetic polypeptide
atgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtggcggcggccacagcaggtcactcacaactggacggtgtatttaaatccgaggagaagcgagcactcagtgatgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagagacccagcctgacccatgtggtggagtggattgattttgagacgctggccctgctgtttggcatgatgatcttagtagccatattttcagaaacgggatttttcgattattgtgctgtaaaggcataccggctctcccggggacgggtgtgggccatgatcatcatgctctgtctcatcgcggccgtcctctctgccttcttggacaacgtcaccaccatgctcctcttcacgcctgtgaccataaggttgtgtgaggtgctcaaccttgatccaagacaagtcctgattgcagaagtgatcttcacaaacattggaggagctgccactgccatcggggaccctccaaatgtcattattgtttccaaccaagagctgaggaagatgggcctggactttgccggattcactgcacacatgttcattgggatttgccttgttctcctggtctgctttccgctcctcagactcctttactggaacagaaagctttataacaaggaacccagtgagattgttgaactgaagcacgagattcacgtctggcgcctgactgctcagcgcatcagcccggccagccgcgaggagacagctgtgcgccgcctgctgctggggaaggtgctggcactggagcacctgctcgcccggaggctgcacaccttccacagacagatctcacaggaggacaaaaattgggagaccaatatccaagaactccaaaaaaagcataggatatctgacgggattctgctcgccaaatgcctgacagtgttgggatttgttatcttcatgtttttcctcaattcgtttgtccctggcattcatcttgatcttggatggattgctattctgggtgccatctggttgctaattttagctgatattcatgattttgagataattctacacagagtggaatgggcaacccttctgttttttgcagcgctctttgttctgatggaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggaagagagagagagagaccagggatgtactcgcacagagaaaagccctatgaggacgtggcaagaaggactgcaaggcaaggaaggaagacctaggagaaaccaaccctgaagacatcttcatcctggacttccagc

SEQ ID NO: 5225 - DNA, 2569 bp, Artificial Sequence
  Synthetic polypeptide
atgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtggcggcggccacagcaggtcactcacaactggacggtgtatttaaatccgaggagaagcgagcactcagtgatgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagatcgtgcacagaactctggcggccatgctgggttcccttgcagcactggcagcactggctgtgattggcgatagacccagcctgacccatgtggtggagtggattgattttgagacgctggccctgctgtttggcatgatgatcttagtagccatattttcagaaacgggatttttcgattattgtgctgtaaaggcataccggctctcccggggacgggtgtgggccatgatcatcatgctctgtctcatcgcggccgtcctctctgccttcttggacaacgtcaccaccatgctcctcttcacgcctgtgaccataaggttgtgtgaggtgctcaaccttgatccaagacaagtcctgattgcagaagtgatcttcacaaacattggaggagctgccactgccatcggggaccctccaaatgtcattattgtttccaaccaagagctgaggaagatgggcctggactttgccggattcactgcacacatgttcattgggatttgccttgttctcctggtctgctttccgctcctcagactcctttactggaacagaaagctttataacaaggaacccagtgagattgttgaactgaagcacgagattcacgtctggcgcctgactgctcagcgcatcagcccggccagccgcgaggagacagctgtgcgccgcctgctgctggggaaggtgctggcactggagcacctgctcgcccggaggctgcacaccttccacagacagatctcacaggaggacaaaaattgggagaccaatatccaagaactccaaaaaaagcataggatatctgacgggattctgctcgccaaatgcctgacagtgttgggatttgttatcttcatgtttttcctcaattcgtttgtccctggcattcatcttgatcttggatggattgctattctgggtgccatctggttgctaattttagctgatattcatgattttgagataattctacacagagtggaatgggcaacccttctgttttttgcagcgctctttgttctgatggaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggaagagagagagagagaccagggatgtactcgcacagagaaaagccctatgaggacgtggcaagaaggactgcaaggcaaggaaggaagacctaggagaaaccaaccctgaagacatcttcatcctggacttccagc

SEQ ID NO: 5226 - DNA, 1736 bp, Artificial Sequence; identical to SEQ ID NO: 156
  Synthetic polypeptide

SEQ ID NO: 5227 - DNA, 1724 bp, Artificial Sequence; identical to SEQ ID NO: 157
  Synthetic polypeptide

SEQ ID NO: 5228 - DNA, 1608 bp, Artificial Sequence
  Synthetic polypeptide
atgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggaccaggacgcccctacagggccatagatttctcacatcaaggacctgcatttgttacctggcaccggtaccatttgttgtgtctggaaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgatagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggaatgctttggaagggtttgataaagcagatgggactctggattctcaagtgatgagccttcataatttggttcattccttcctgaacgggacaaacgctttgccacattcagccgccaatgatcccatttttgtggttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccagataggactgtctccttgcaggaaaacaagctcagggctcccagattctgcattatggtgagttgtataattatttcattatatattataatgtaataataatagaaagaaagtgcacaataaatgtaatgcacttgaatcatcctgaaaccattacctctctaatcctagttcatggaaagattgtcttccatgaaactggtccctggtgtcaaaaaggttgaggac

SEQ ID NO: 5229 - DNA, 1707 bp, Artificial Sequence
  Synthetic polypeptide
atgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggaccaggacgcccctacagggccatagatttctcacatcaaggacctgcatttgttacctggcaccggtaccatttgttgtgtctggaaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgatagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggaatgctttggaagggtttgataaagcagatgggactctggattctcaagtgatgagccttcataatttggttcattccttcctgaacgggacaaacgctttgccacattcagccgccaatgatcccatttttgtggtgatttctaatcgtttgctttacaatgctacaacaaacatccttgaacatgtaagaaaagagaaagcgaccaaggaactcccttccctgcatgtgctggttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccagataggactgtctccttgcaggaaaacaagctcagggctcccagattctgcattatggtgagttgtataattatttcattatatattataatgtaataataatagaaagaaagtgcacaataaatgtaatgcacttgaatcatcctgaaaccattacctctctaatcctagttcatggaaagattgtcttccatgaaactggtccctggtgtcaaaaaggttgaggac

SEQ ID NO: 5230 - DNA, 2151 bp, Artificial Sequence; identical to SEQ ID NO: 127
  Synthetic polypeptide

SEQ ID NO: 5231 - DNA, 1833 bp, Artificial Sequence; identical to SEQ ID NO: 126
  Synthetic polypeptide

SEQ ID NO: 5232 - DNA, 3332 bp, Artificial Sequence
  Synthetic polypeptide
atggagaacgttgataattctctggatggcagtgatgtgtcagaaccagcaaaaccagaagccggacttgaagtggctcagtcgatcctgagtaagttctctatgaaatccctatttgggtttacgagtaaattagaatctgtgaatccagaagaggaagatgctgtgctgaaagcattccatagtttagacgtgaatcccacatctcagcaggatgattccagcaatggcttggatccacaggaagcagggtctcgggtttcacctgacctcggaaatgatgagaaaattgcaagcgtggagacagaatcagagggaagtcagagaaaagaagcagggacatctctccttgctcaagagctgcttccactgtctactttgaaagggacaaaagacgatgtcatttgtgttcgtgggaccctggtgcacaccaccagtgattctgactctgatgatggtggccaggagccagaggagggaagcagcaccaatggcccaaagtcccctagtggtgttttatctgagccatctcaggagtccaaagaaaacccaggaggtttcagggaaaatactgtcactggggaaatgaatggtgcagagctctgtgcagaagatcctcaaaggattccacctgagatgagcagcaaactggaagctggcaacggtggtcttcagacagagcgtcgccccagccaggaccaggtgggagaagaagggtcccaagacctacctgcagtaacaaaccagaattcgagtgttggtatcactgagagtgcctcttctaaaaaagaagtctctggagagaagtcattccaacttccagcttttttcagtgggcttcgtgtgctgaagaagggggctaccgctgagggaggagagaccatcacggaaattaaaccaaaggatggggacttagctttgctcaaattgacgcagcctgtgcagaagtccttagtgcaggcagggctgcagacagtgaagagtgagaagaaagcaactgatccgaaggccactcccactctcctggagcagctctctctgctgctcaacattgacatgcccaaaactgaaccgaagggagcagaccctgagtcgcccaggagagaagagatgggctgcaatgctgaccaagagagccagagcggccctggagtaccacaaacccagggtggtgaggtcaagccaaagtcgccagagacagccctggaggcttttaaagccctattcatccggccccccagaaaggggaccacagctgacacctctgagctggaagctctcaagcgcaagatgagacatgagaaggagtcgctaagagctgtgtttgaacggtccaattctaagccagcggatggcccctctgattccaaaagtcctgaccacagcctgactgagcaggatgacaggactcctggcagacttcaagctgtctggccacccccaaagacaaaagacacagaagaaaaagtgggactgaagtacactgaagcagaataccaagctgctattttacacttgaagagggagcacaaagaagaaattgaaaacctgcaggcacagtttgaacttcgggcatttcatatccggggcgagcatgcaatgataacagcgagactagaagaaaccattgaaaatctgaaacacgagctagaacacagatggcgagggggttgtgaagagaggaaagatgtgtgcatttccaccgatgatgactgccctccaaagaccttcagaaatgtgtgcgtccagacagacagagagaccttcctcaagccctgtgaaagtgaaagcaagacaaccagaagtaatcaattagtacccaaaaagctgaatatctcctctttaagccagctctcacccccaaatgaccacaaagacatccatgcagcactccagccaatggagggcatggcatcaaatcagcagaaggcattgcctccgcctcccgcatccatccctccccctccgcccctcccctcaggacttggatctttgtctcccgcacctccaatgccacctgtgagtgctgggccaccgctaccacctccgcctcctccaccgccacctctacctccaccttcaagtgctggacctccaccacccccacccccacccccacttcctaactcccctgccccacccaaccctggagggcctcctcctgctccaccacccccaggacttgcacccccacctccccctggactcttctttggacttggctcttcttccagtcaatgtcctcgaaaaccagccatcgagcccagttgtcccatgaagcctttatattggactaggatacaaataagtgataggagccaaaatgctacaccaaccttatgggactccttagaagaacctgacattcgggaccccagtgaatttgagtatttattctccaaagacacaactcaacagaagaaaaaacctctgtcagagacttatgagaagaaaaacaaggtcaaaaagatcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggataatgggattaatctggtggactacgttgttaagtattacctgcgttactatgatcaggaagctggaacagaaaagagtgttttccccttgccggaaccacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaagctggttcttcatcttcccaatctctaaacacaagagggcttcaggactcagtccatgaaccccttgccttatc

SEQ ID NO: 5233 - DNA, 3707 bp, Artificial Sequence
  Synthetic polypeptide
atggaaggcactcattgtaccctccaattgcataagcccattacggaactctgctacatcagcttctgtcttccaaagggggaagtcagaggattttcatacaagggcactgtaactctagacagatccaataaaggttttcataactgctaccaagtcagggaggagtcagacatcatcagcctcagccaggagccggacgaacatccaggcgacatatttttcaagcagactcccacgaaagacattctaactgagctgtacaaactcacaacagagagggagagactgctaaccaatctcctgagctcagaccacatcctggggatcacgatggggaaccaggaggggaagctgcaagagctgtccgtgagcctggcccccgaggatgactgtttccagagtgctggtgactggcagggagagctccccgtgggccctctcaataagaggagcacccacgggaacaaaaagcctcggaggtctagtggaaggagagagagctttggggcccttccacagaagaggaccaaaagaaaagggcgtggaggccgagaatcagctcctctgatgggcaaggacaagatctgttccagccactcccttcctctttctagaacaaggcctaacctttgggtactagaggagaaaggaaatctgctcccgaatggggcacttgcctgctccctgcagaggagagagagctgccccccagatattcccaagacgccagacacagaccttggctttgggagctttgagacggctttcaaggacactgggcttggaagagaagtgctgccccctgactgcagctccacagaggcaggaggggatggcattcggaggccgccgagcgggctggagcatcagcaaacaggtttgtctgaaagtcaccaggaccctgagaagcatccagaggcagaaaaggatgagatggagaagccggctaagcggacttgcaagcagaaacctgtctccaaagtggtggccaaagttcaggacctgtcctcccaggtacaaagagtagttaaaacgcattctaagggtaaggagacgattgccattcgcccagcagcccacgctgagtttgtacccaaagccgacttgctcaccctcccgggagctgaggctggggctcatggctccaggcggcagggcaaggagcggcaaggggataggtcatcgcagtcgccagccggggaaacagcctccatttctagtgtgtcggccagtgccgagggggccgtgaacaaggtccccctgaaggtgatagagagtgagaagttagatgaagcccctgaggggaaaagactgggcttccctgtccacacgagtgtccctcacactcgcccagaaacgagaaacaagaggagagccgggttgccccttggtggccacaagtccttgtttctggatctgccccacaaagtaggtcctgactcctcacaacccagaggtgataagaagaagccatccccaccagcaccggcagctcttggcaaggtgtttaataattcagcctcgcagtccagcacacacaaacagacgtcacctgttccctcgcctctgtctccaaggctccccagccctcagcagcatcacaggatcctccggctccctgcattgcctggtgagagggaagctgctcttaatgactctccttgtagaaagagccgtgtcttctctgggtgcgtctctgctgacaccttggagccaccatcctctgcaaaggtcacggagaccaaaggagccagcccggccttcctcagagcaggccaacctcggttggtgcctggggaaactttggaaaagagcttggggccagggaagaccacagctgagccccagcaccagtcacctccagaataccaagctgctattttacacttgaagagggagcacaaagaagaaattgaaaacctgcaggcacagtttgaacttcgggcatttcatatccggggcgagcatgcaatgataacagcgagactagaagaaaccattgaaaatctgaaacacgagctagaacacagatggcgagggggttgtgaagagaggaaagatgtgtgcatttccaccgatgatgactgccctccaaagaccttcagaaatgtgtgcgtccagacagacagagagaccttcctcaagccctgtgaaagtgaaagcaagacaaccagaagtaatcaattagtacccaaaaagctgaatatctcctctttaagccagctctcacccccaaatgaccacaaagacatccatgcagcactccagccaatggagggcatggcatcaaatcagcagaaggcattgcctccgcctcccgcatccatccctccccctccgcccctcccctcaggacttggatctttgtctcccgcacctccaatgccacctgtgagtgctgggccaccgctaccacctccgcctcctccaccgccacctctacctccaccttcaagtgctggacctccaccacccccacccccacccccacttcctaactcccctgccccacccaaccctggagggcctcctcctgctccaccacccccaggacttgcacccccacctccccctggactcttctttggacttggctcttcttccagtcaatgtcctcgaaaaccagccatcgagcccagttgtcccatgaagcctttatattggactaggatacaaataagtgataggagccaaaatgctacaccaaccttatgggactccttagaagaacctgacattcgggaccccagtgaatttgagtatttattctccaaagacacaactcaacagaagaaaaaacctctgtcagagacttatgagaagaaaaacaaggtcaaaaagatcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggataatgggattaatctggtggactacgttgttaagtattacctgcgttactatgatcaggaagctggaacagaaaagagtgttttccccttgccggaaccacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaagctggttcttcatcttcccaatctctaaacacaagagggcttcaggactcagtccatgaaccccttgccttatc

SEQ ID NO: 5234 - DNA, 4001 bp, Artificial Sequence
  Synthetic polypeptide
atggaaggcactcattgtaccctccaattgcataagcccattacggaactctgctacatcagcttctgtcttccaaagggggaagtcagaggattttcatacaagggcactgtaactctagacagatccaataaaggttttcataactgctaccaagtcagggaggagtcagacatcatcagcctcagccaggagccggacgaacatccaggcgacatatttttcaagcagactcccacgaaagacattctaactgagctgtacaaactcacaacagagagggagagactgctaaccaatctcctgagctcagaccacatcctggggatcacgatggggaaccaggaggggaagctgcaagagctgtccgtgagcctggcccccgaggatgactgtttccagagtgctggtgactggcagggagagctccccgtgggccctctcaataagaggagcacccacgggaacaaaaagcctcggaggtctagtggaaggagagagagctttggggcccttccacagaagaggaccaaaagaaaagggcgtggaggccgagaatcagctcctctgatgggcaaggacaagatctgttccagccactcccttcctctttctagaacaaggcctaacctttgggtactagaggagaaaggaaatctgctcccgaatggggcacttgcctgctccctgcagaggagagagagctgccccccagatattcccaagacgccagacacagaccttggctttgggagctttgagacggctttcaaggacactgggcttggaagagaagtgctgccccctgactgcagctccacagaggcaggaggggatggcattcggaggccgccgagcgggctggagcatcagcaaacaggtttgtctgaaagtcaccaggaccctgagaagcatccagaggcagaaaaggatgagatggagaagccggctaagcggacttgcaagcagaaacctgtctccaaagtggtggccaaagttcaggacctgtcctcccaggtacaaagagtagttaaaacgcattctaagggtaaggagacgattgccattcgcccagcagcccacgctgagtttgtacccaaagccgacttgctcaccctcccgggagctgaggctggggctcatggctccaggcggcagggcaaggagcggcaaggggataggtcatcgcagtcgccagccggggaaacagcctccatttctagtgtgtcggccagtgccgagggggccgtgaacaaggtccccctgaaggtgatagagagtgagaagttagatgaagcccctgaggggaaaagactgggcttccctgtccacacgagtgtccctcacactcgcccagaaacgagaaacaagaggagagccgggttgccccttggtggccacaagtccttgtttctggatctgccccacaaagtaggtcctgactcctcacaacccagaggtgataagaagaagccatccccaccagcaccggcagctcttggcaaggtgtttaataattcagcctcgcagtccagcacacacaaacagacgtcacctgttccctcgcctctgtctccaaggctccccagccctcagcagcatcacaggatcctccggctccctgcattgcctggtgagagggaagctgctcttaatgactctccttgtagaaagagccgtgtcttctctgggtgcgtctctgctgacaccttggagccaccatcctctgcaaaggtcacggagaccaaaggagccagcccggccttcctcagagcaggccaacctcggttggtgcctggggaaactttggaaaagagcttggggccagggaagaccacagctgagccccagcaccagtcacctccaggtatctcctctgagggctttccctgggacggcttcaatgagcagacacctaaagaccttcccaacagagatggaggcgcgtgggttctgggctacagagcgggaccagcctgtccatttttgcttcatgaggaaagggagaagtcaaacaggagcgaattgtacttggatctccatcctgaccacagcctgactgagcaggatgacaggactcctggcagacttcaagctgtctggccacccccaaagacaaaagacacagaagaaaaagtgggactgaagtacactgaagcagaataccaagctgctattttacacttgaagagggagcacaaagaagaaattgaaaacctgcaggcacagtttgaacttcgggcatttcatatccggggcgagcatgcaatgataacagcgagactagaagaaaccattgaaaatctgaaacacgagctagaacacagatggcgagggggttgtgaagagaggaaagatgtgtgcatttccaccgatgatgactgccctccaaagaccttcagaaatgtgtgcgtccagacagacagagagaccttcctcaagccctgtgaaagtgaaagcaagacaaccagaagtaatcaattagtacccaaaaagctgaatatctcctctttaagccagctctcacccccaaatgaccacaaagacatccatgcagcactccagccaatggagggcatggcatcaaatcagcagaaggcattgcctccgcctcccgcatccatccctccccctccgcccctcccctcaggacttggatctttgtctcccgcacctccaatgccacctgtgagtgctgggccaccgctaccacctccgcctcctccaccgccacctctacctccaccttcaagtgctggacctccaccacccccacccccacccccacttcctaactcccctgccccacccaaccctggagggcctcctcctgctccaccacccccaggacttgcacccccacctccccctggactcttctttggacttggctcttcttccagtcaatgtcctcgaaaaccagccatcgagcccagttgtcccatgaagcctttatattggactaggatacaaataagtgataggagccaaaatgctacaccaaccttatgggactccttagaagaacctgacattcgggaccccagtgaatttgagtatttattctccaaagacacaactcaacagaagaaaaaacctctgtcagagacttatgagaagaaaaacaaggtcaaaaagatcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggataatgggattaatctggtggactacgttgttaagtattacctgcgttactatgatcaggaagctggaacagaaaagagtgttttccccttgccggaaccacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaagctggttcttcatcttcccaatctctaaacacaagagggcttcaggactcagtccatgaaccccttgccttatc

SEQ ID NO: 5235 - DNA, 249 bp, Artificial Sequence
  Synthetic polypeptide
accacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaagctggttcttcatcttcccaatctctaaacacaagagggcttcaggactcagtccatgaaccccttgccttatc

SEQ ID NO: 5236 - DNA, 516 bp, Artificial Sequence
  Synthetic polypeptide
atgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaaggacatgcagagagacaccagggatgtgcgcagagggaccgccatgtgaagaagcagcaagaggagcaagaggacggccatctgcaagccaagggggaagccacctgcccacaccttgatctgagacttccggcctccacaaccgtgagaagatacgtgtccgttgtttaagctgcccagtctgcggtgctttgttctggcagcc

SEQ ID NO: 5237 - DNA, 48 bp, Artificial Sequence
  Synthetic polypeptide
atgtttggcactgaatcttcatagaaaaatatttgttgaatgagtgaa

SEQ ID NO: 5238 - DNA, 2161 bp, Artificial Sequence; identical to SEQ ID NO: 288
  Synthetic polypeptide

SEQ ID NO: 5239 - DNA, 2140 bp, Artificial Sequence; identical to SEQ ID NO: 289
  Synthetic polypeptide

SEQ ID NO: 5240 - DNA, 529 bp, Artificial Sequence; identical to SEQ ID NO: 287
  Synthetic polypeptide

SEQ ID NO: 5241 - DNA, 550 bp, Artificial Sequence; identical to SEQ ID NO: 3092
  Synthetic polypeptide

SEQ ID NO: 5242 - DNA, 412 bp, Artificial Sequence; identical to SEQ ID NO: 3093
  Synthetic polypeptide

SEQ ID NO: 5243 - DNA, 798 bp, Artificial Sequence; identical to SEQ ID NO: 3839
  Synthetic polypeptide

SEQ ID NO: 5244 - DNA, 609 bp, Artificial Sequence; identical to SEQ ID NO: 249
  Synthetic polypeptide

SEQ ID NO: 5245 - DNA, 738 bp, Artificial Sequence; identical to SEQ ID NO: 250
  Synthetic polypeptide

SEQ ID NO: 5246 - DNA, 537 bp, Artificial Sequence; identical to SEQ ID NO: 251
  Synthetic polypeptide

SEQ ID NO: 5247 - DNA, 684 bp, Artificial Sequence; identical to SEQ ID NO: 253
  Synthetic polypeptide

SEQ ID NO: 5248 - DNA, 285 bp, Artificial Sequence; identical to SEQ ID NO: 255
  Synthetic polypeptide

SEQ ID NO: 5249 - DNA, 552 bp, Artificial Sequence; identical to SEQ ID NO: 254
  Synthetic polypeptide

SEQ ID NO: 5250 - DNA, 344 bp, Artificial Sequence; identical to SEQ ID NO: 5133
  Synthetic polypeptide

SEQ ID NO: 5251 - DNA, 775 bp, Artificial Sequence; identical to SEQ ID NO: 215
  Synthetic polypeptide

SEQ ID NO: 5252 - DNA, 1823 bp, Artificial Sequence; identical to SEQ ID NO: 2096
  Synthetic polypeptide

SEQ ID NO: 5253 - DNA, 1859 bp, Artificial Sequence; identical to SEQ ID NO: 2097
  Synthetic polypeptide

SEQ ID NO: 5254 - DNA, 1526 bp, Artificial Sequence; identical to SEQ ID NO: 2098
  Synthetic polypeptide

SEQ ID NO: 5255 - DNA, 1685 bp, Artificial Sequence; identical to SEQ ID NO: 2099
  Synthetic polypeptide

SEQ ID NO: 5256 - DNA, 503 bp, Artificial Sequence
  Synthetic polypeptide
atggccagcccttccggcagctccgaagccactggcaagccccgaggcagggatggccggcccaggagggaagaggacgacgtccctcccgaagagaagaggctgcggctgttgctggaggggggaagcgcagaacctgaggactgcgaggacggggaggacgtgccgcggccaggcagggaggagaccgggacccagacaggtggcgacggcagaggagcgcagtggctcacacctgtaatcctagcactttgggaggccaaggcgggtggatcgtgaggtcaggagttcgggaccagcctggccaatatggtgaaaccccatcactactaaaaatacaaaaattagccaggcacggtggtgtgtgcctgtagtcccagttacttgggaggctgaggcagaagaatctcttgaacccaggagagaggttgcagtgagccgagatcgtgccactgcactccagcctgggtaacaaagcaagactccatctcaaaaataaaaaa

SEQ ID NO: 5257 - DNA, 1855 bp, Artificial Sequence
  Synthetic polypeptide
atgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccaggatccgactcagtgggggccgcagccaacatgaggggcgagtcgaggtgcaaatagggggacctgggccccttcgctggggcctcatctgtggggatgactgggggaccctggaggccatggtggcctgtaggcaactgggtctgggctacgccaaccacggcctgcaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagacactttaggaggccaaggcggatggatcacgaggtcaggaattcaagaccagcctgaccaagatggtgaaaccctgtctctactaaaactacaaaaattagccaggcgcagtggcaggcgcctataatcccagctactcgggaggctgaggcaggagaatcacttgaacccaggtggcagaggttgcagtgagccaagatcacgccgctgcattccagcctcggcaacagagtgagactccatctcaaacaaacaaacaaacaaaaacaaaaacaa

SEQ ID NO: 5258 - DNA, 1420 bp, Artificial Sequence
  Synthetic polypeptide
atgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccaggatccgactcagtgggggccgcagccaacatgaggggcgagtcgaggtgcaaatagggggacctgggccccttcgctggggcctcatctgtggggatgactgggggaccctggaggccatggtggcctgtaggcaactgggtctgggctacgccaaccacggcctgcaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagacactttaggaggccaaggcggatggatcacgaggtcaggaattcaagaccagcctgaccaagatggtgaaaccctgtctctactaaaactacaaaaattagccaggcgcagtggcaggcgcctataatcccagctactcgggaggctgaggcaggagaatcacttgaacccaggtggcagaggttgcagtgagccaagatcacgccgctgcattccagcctcggcaacagagtgagactccatctcaaacaaacaaacaaacaaaaacaaaaacaa

SEQ ID NO: 5259 - DNA, 1687 bp, Artificial Sequence
  Synthetic polypeptide
atgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccagggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagacactttaggaggccaaggcggatggatcacgaggtcaggaattcaagaccagcctgaccaagatggtgaaaccctgtctctactaaaactacaaaaattagccaggcgcagtggcaggcgcctataatcccagctactcgggaggctgaggcaggagaatcacttgaacccaggtggcagaggttgcagtgagccaagatcacgccgctgcattccagcctcggcaacagagtgagactccatctcaaacaaacaaacaaacaaaaacaaaaacaa

SEQ ID NO: 5260 - DNA, 1452 bp, Artificial Sequence; identical to SEQ ID NO: 3717
  Synthetic polypeptide

SEQ ID NO: 5261 - DNA, 1155 bp, Artificial Sequence; identical to SEQ ID NO: 3718
  Synthetic polypeptide

SEQ ID NO: 5262 - DNA, 1278 bp, Artificial Sequence; identical to SEQ ID NO: 3719
  Synthetic polypeptide

SEQ ID NO: 5263 - DNA, 558 bp, Artificial Sequence; identical to SEQ ID NO: 2797
  Synthetic polypeptide

SEQ ID NO: 5264 - DNA, 214 bp, Artificial Sequence
  Synthetic polypeptide
atgtggtcgacgagaagccccaacagcacggcgtggcctctcagcctcgatccccttctgctttttgccatgagtgggagcagtatgaggccctcaccagatgcagctgcccaatttggacttcccagccactagaactgtgagccaaacaaacctctcttctttacaaattacccaagtattcagctatagcaactcaaattggactgagaca

SEQ ID NO: 5265 - DNA, 1601 bp, Artificial Sequence
  Synthetic polypeptide
atggcgttcaggagacaagtgaaaaactttgtgaaaaattactcagatgctgaaataaaagtcagggaagcaacttctaacgacccttggggtccctctagttctctgatgttagatatcagtgacttgactttcaacacaatttctctctcagagattatgaatatgctgtggcacagactcaatgaccatgggaagaactggcgccacgtgtataaatcccttaccctaatggattatctcatcaagaatggatcaaagaaagttattcagcattgcagagaggggttctgtaaccttcaaacactaaaagattttcagcacatagatgaagctggaaaagaccaaggttattatatccgggaaaaatctaagcaagtcatcacattgctgatggatgaaccattgctgtgtaaagagagggaagtggcatgtcggactagacagcgtacctcccactctatattgttttctaaaagacaacttggttcaagtaactcactgacagcgtgcacttctgcccccacaccggatatttctgcttcagagaagaagtataagcttcctaagtttggaaggttacataataaaacccatggatcaaggagtgatttcaactttcaagtcttattactgaagaaatacatttcataaagctatatcttccatagatagtgattcctctgatggatctgagcaaagtaaattaaaaaccttctggaaaagattcaccactctagatgccattaagaacatttgtgattcatgggaggaagccaaaatttcaacattaacaggagtttgaaagaagtggattccaacccttatggatgactttgaggggttcaagacttcagtggaggaaggaactgcagatgtggcggaaatagcaagagaactagaattagaagtggagcctgaagatgtgactggattgctgcaatctcatgatcaaacttgaacagatgaggagatacttcttatggatgagcaaagaaaatggtttcttgagttgaaatctactcctgtgaagaagctgtgaacattgttgcaatgccaacaaagaattcagaatattacataaacttagtaaataaaccagtggcaggattagagaggattgactccaattttgaaagaagttctactgtgggtaaaatgctatcaaacagcatcacatgctacagataaatcttttgtgaaaggaagagtcagttgatgttgcaggctttattgttgtcttactttaaaaaattgccacagctttcccaaccttcagcagcaaccaccctgatctatcagcagccctcaacatggagacaagaccctccaccagcaaaaagatgaagactcgctgaaggctcagatgattgttagcctttttaaattagcaataaagtattatttaattatgtatatatattttttaggcagcatggtattgcatacttagtctactaagtagactgcagtctaatgtaaacataacttttatatgcactgggaaacaaaaatgtttgtgtgagtggctttattggaatatttgctttattgcagtaatctggaacccagcccaccgcagtatcttcaaggtgtgcctg

SEQ ID NO: 5266 - DNA, 118 bp, Artificial Sequence; identical to SEQ ID NO: 4271
  Synthetic polypeptide

SEQ ID NO: 5267 - DNA, 1273 bp, Artificial Sequence; identical to SEQ ID NO: 1927
  Synthetic polypeptide

SEQ ID NO: 5268 - DNA, 1516 bp, Artificial Sequence; identical to SEQ ID NO: 1928
  Synthetic polypeptide

SEQ ID NO: 5269 - DNA, 1393 bp, Artificial Sequence; identical to SEQ ID NO: 1929
  Synthetic polypeptide

SEQ ID NO: 5270 - DNA, 1146 bp, Artificial Sequence; identical to SEQ ID NO: 988
  Synthetic polypeptide

SEQ ID NO: 5271 - DNA, 412 bp, Artificial Sequence; identical to SEQ ID NO: 1704
  Synthetic polypeptide

SEQ ID NO: 5272 - DNA, 487 bp, Artificial Sequence; identical to SEQ ID NO: 918
  Synthetic polypeptide

SEQ ID NO: 5273 - DNA, 254 bp, Artificial Sequence; identical to SEQ ID NO: 1993
  Synthetic polypeptide

SEQ ID NO: 5274 - DNA, 1398 bp, Artificial Sequence; identical to SEQ ID NO: 948
  Synthetic polypeptide

SEQ ID NO: 5275 - DNA, 1302 bp, Artificial Sequence; identical to SEQ ID NO: 949
  Synthetic polypeptide

SEQ ID NO: 5276 - DNA, 640 bp, Artificial Sequence; identical to SEQ ID NO: 1700
  Synthetic polypeptide

SEQ ID NO: 5277 - DNA, 1391 bp, Artificial Sequence; identical to SEQ ID NO: 1950
  Synthetic polypeptide

SEQ ID NO: 5278 - DNA, 1394 bp, Artificial Sequence; identical to SEQ ID NO: 1951
  Synthetic polypeptide

SEQ ID NO: 5279 - DNA, 385 bp, Artificial Sequence; identical to SEQ ID NO: 1938
  Synthetic polypeptide

SEQ ID NO: 5280 - DNA, 1058 bp, Artificial Sequence; identical to SEQ ID NO: 1966
  Synthetic polypeptide

SEQ ID NO: 5281 - DNA, 725 bp, Artificial Sequence; identical to SEQ ID NO: 1705
  Synthetic polypeptide

SEQ ID NO: 5282 - DNA, 815 bp, Artificial Sequence; identical to SEQ ID NO: 1706
  Synthetic polypeptide

SEQ ID NO: 5283 - DNA, 361 bp, Artificial Sequence; identical to SEQ ID NO: 1916
  Synthetic polypeptide

SEQ ID NO: 5284 - DNA, 575 bp, Artificial Sequence; identical to SEQ ID NO: 2296
  Synthetic polypeptide

SEQ ID NO: 5285 - DNA, 100 bp, Artificial Sequence
  Synthetic polypeptide
atgatggctcagtttcccacagctatgaatggttaatgctgggggctcagtgagttgctgcatataaagtccctgacaatagtcagggttcaataaaggt

SEQ ID NO: 5286 - DNA, 1231 bp, Artificial Sequence; identical to SEQ ID NO: 1238
  Synthetic polypeptide

SEQ ID NO: 5287 - DNA, 823 bp, Artificial Sequence; identical to SEQ ID NO: 1941
  Synthetic polypeptide

SEQ ID NO: 5288 - DNA, 715 bp, Artificial Sequence; identical to SEQ ID NO: 1942
  Synthetic polypeptide

SEQ ID NO: 5289 - DNA, 299 bp, Artificial Sequence; identical to SEQ ID NO: 1943
  Synthetic polypeptide

SEQ ID NO: 5290 - DNA, 148 bp, Artificial Sequence; identical to SEQ ID NO: 1944
  Synthetic polypeptide

SEQ ID NO: 5291 - DNA, 578 bp, Artificial Sequence; identical to SEQ ID NO: 1946
  Synthetic polypeptide

SEQ ID NO: 5292 - DNA, 488 bp, Artificial Sequence; identical to SEQ ID NO: 1947
  Synthetic polypeptide

SEQ ID NO: 5293 - DNA, 479 bp, Artificial Sequence; identical to SEQ ID NO: 1948
  Synthetic polypeptide

SEQ ID NO: 5294 - DNA, 470 bp, Artificial Sequence; identical to SEQ ID NO: 1949
  Synthetic polypeptide

SEQ ID NO: 5295 - DNA, 3093 bp, Artificial Sequence; identical to SEQ ID NO: 341
  Synthetic polypeptide

SEQ ID NO: 5296 - DNA, 2979 bp, Artificial Sequence; identical to SEQ ID NO: 342
  Synthetic polypeptide

SEQ ID NO: 5297 - DNA, 3078 bp, Artificial Sequence; identical to SEQ ID NO: 343
  Synthetic polypeptide

SEQ ID NO: 5298 - DNA, 3072 bp, Artificial Sequence; identical to SEQ ID NO: 346
  Synthetic polypeptide

SEQ ID NO: 5299 - DNA, 1935 bp, Artificial Sequence; identical to SEQ ID NO: 347
  Synthetic polypeptide

SEQ ID NO: 5300 - DNA, 1096 bp, Artificial Sequence; identical to SEQ ID NO: 348
  Synthetic polypeptide

SEQ ID NO: 5301 - DNA, 902 bp, Artificial Sequence; identical to SEQ ID NO: 349
  Synthetic polypeptide

SEQ ID NO: 5302 - DNA, 874 bp, Artificial Sequence; identical to SEQ ID NO: 350
  Synthetic polypeptide

SEQ ID NO: 5303 - DNA, 314 bp, Artificial Sequence; identical to SEQ ID NO: 998
  Synthetic polypeptide

SEQ ID NO: 5304 - DNA, 193 bp, Artificial Sequence; identical to SEQ ID NO: 975
  Synthetic polypeptide

SEQ ID NO: 5305 - DNA, 1705 bp, Artificial Sequence; identical to SEQ ID NO: 1989
  Synthetic polypeptide

SEQ ID NO: 5306 - DNA, 873 bp, Artificial Sequence
  Synthetic polypeptide
atggggctgtttggaaagacccaggagaagccgcccaaagaactggtcaatgagtggtcattgaagataagaaaggaaatgagagttgttgacaggcaaataaggggatccattggagtctttggctgaatactaagctgtgcatgcttagagtgaaatttcaagagactgggcaaagaacaattactaggaacagaacaactaccaggaagctgtaagctgaataattcttagagctaataaaggattgagaagtggttgagctctgatcagacacagaaaagagactttgttgaacctctgggatgttcaatagagacctcagaagagtcacaccttaataataaggatcaggtaggtagtcctagaaaaaaggctaccacaagcccataccaaccaaccaacaagacttaaaagacttcacggctgatttgcaggtaatttgactgcctgccaaagtaaagattaacactgtttaagggaagactacaaaatgcaggcacccaacaatgaaacatatacagtggccagcatccaataagatactattatgaagaagcaggaaaatgtgaccccaaaacaggagaaaagccaggtaatagaaatagatttaaaaaaaaaaaacacccaaaacccccacaaaaaaagatgattgaatttgcagtcaaggatttttaagcagctattataaatatgttgagattaaaggataacttaaacataatgaggagataaatacaaaatacagaaaacaacaaaatggaatttctagagttgaaagatctgaaatgaagtgaaattaaatgaagaatcactgaatgggtttaacagcaaattagacactacagaaaacaagatcagtgaaattgaaga

SEQ ID NO: 5307 - DNA, 960 bp, Artificial Sequence
  Synthetic polypeptide
atggagggtgagctctattctgctctcaaggaagaagaagcatccgaatcggtttctagtaccaatttcagtggtgaaatgcacttctatgagcttgtggaagacacaaaagatggcatctggctggttcaggtcaatgagtggtcattgaagataagaaaggaaatgagagttgttgacaggcaaataaggggatccattggagtctttggctgaatactaagctgtgcatgcttagagtgaaatttcaagagactgggcaaagaacaattactaggaacagaacaactaccaggaagctgtaagctgaataattcttagagctaataaaggattgagaagtggttgagctctgatcagacacagaaaagagactttgttgaacctctgggatgttcaatagagacctcagaagagtcacaccttaataataaggatcaggtaggtagtcctagaaaaaaggctaccacaagcccataccaaccaaccaacaagacttaaaagacttcacggctgatttgcaggtaatttgactgcctgccaaagtaaagattaacactgtttaagggaagactacaaaatgcaggcacccaacaatgaaacatatacagtggccagcatccaataagatactattatgaagaagcaggaaaatgtgaccccaaaacaggagaaaagccaggtaatagaaatagatttaaaaaaaaaaaacacccaaaacccccacaaaaaaagatgattgaatttgcagtcaaggatttttaagcagctattataaatatgttgagattaaaggataacttaaacataatgaggagataaatacaaaatacagaaaacaacaaaatggaatttctagagttgaaagatctgaaatgaagtgaaattaaatgaagaatcactgaatgggtttaacagcaaattagacactacagaaaacaagatcagtgaaattgaaga

SEQ ID NO: 5308 - DNA, 1194 bp, Artificial Sequence
  Synthetic polypeptide
atgtggctgaagctttttttcttgctcctctatttcctggtcctgttcgtcctggccaggttttttgaggccattgtgtggtatgaaactggcatctttgccacccagctggtggatccggtggcgctgagcttcaagaagctgaagaccattttggagtgccgggggttgggctactcagggttgcccgagaagaaggatgtccgggagctggtggaaaagtcaggtgacttgatggagggtgagctctattctgctctcaaggaagaagaagcatccgaatcggtttctagtaccaatttcagtggtgaaatgcacttctatgagcttgtggaagacacaaaagatggcatctggctggttcaggtcaatgagtggtcattgaagataagaaaggaaatgagagttgttgacaggcaaataaggggatccattggagtctttggctgaatactaagctgtgcatgcttagagtgaaatttcaagagactgggcaaagaacaattactaggaacagaacaactaccaggaagctgtaagctgaataattcttagagctaataaaggattgagaagtggttgagctctgatcagacacagaaaagagactttgttgaacctctgggatgttcaatagagacctcagaagagtcacaccttaataataaggatcaggtaggtagtcctagaaaaaaggctaccacaagcccataccaaccaaccaacaagacttaaaagacttcacggctgatttgcaggtaatttgactgcctgccaaagtaaagattaacactgtttaagggaagactacaaaatgcaggcacccaacaatgaaacatatacagtggccagcatccaataagatactattatgaagaagcaggaaaatgtgaccccaaaacaggagaaaagccaggtaatagaaatagatttaaaaaaaaaaaacacccaaaacccccacaaaaaaagatgattgaatttgcagtcaaggatttttaagcagctattataaatatgttgagattaaaggataacttaaacataatgaggagataaatacaaaatacagaaaacaacaaaatggaatttctagagttgaaagatctgaaatgaagtgaaattaaatgaagaatcactgaatgggtttaacagcaaattagacactacagaaaacaagatcagtgaaattgaaga

SEQ ID NO: 5309 - DNA, 298 bp, Artificial Sequence
  Synthetic polypeptide
atgcgcgcccgccgggggctgctgcggctgccgcgccgctcgctgctcgccgcgctcttcttcttttctctctcgtcctcgctgctgtacttcgtctatgtggcgcccggcatagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcagaaaggcagcacagagtacagaagggaggaatcatcaccgagagaatac

SEQ ID NO: 5310 - DNA, 645 bp, Artificial Sequence; identical to SEQ ID NO: 4051
  Synthetic polypeptide

SEQ ID NO: 5311 - DNA, 506 bp, Artificial Sequence; identical to SEQ ID NO: 1096
  Synthetic polypeptide

SEQ ID NO: 5312 - DNA, 1168 bp, Artificial Sequence; identical to SEQ ID NO: 1703
  Synthetic polypeptide

SEQ ID NO: 5313 - DNA, 2721 bp, Artificial Sequence; identical to SEQ ID NO: 962
  Synthetic polypeptide

SEQ ID NO: 5314 - DNA, 2549 bp, Artificial Sequence; identical to SEQ ID NO: 963
  Synthetic polypeptide

SEQ ID NO: 5315 - DNA, 822 bp, Artificial Sequence; identical to SEQ ID NO: 119
  Synthetic polypeptide

SEQ ID NO: 5316 - DNA, 2030 bp, Artificial Sequence; identical to SEQ ID NO: 1961
  Synthetic polypeptide

SEQ ID NO: 5317 - DNA, 1847 bp, Artificial Sequence; identical to SEQ ID NO: 1962
  Synthetic polypeptide

SEQ ID NO: 5318 - DNA, 1395 bp, Artificial Sequence; identical to SEQ ID NO: 1963
  Synthetic polypeptide

SEQ ID NO: 5319 - DNA, 1398 bp, Artificial Sequence; identical to SEQ ID NO: 1964
  Synthetic polypeptide

SEQ ID NO: 5320 - DNA, 569 bp, Artificial Sequence; identical to SEQ ID NO: 426
  Synthetic polypeptide

SEQ ID NO: 5321 - DNA, 181 bp, Artificial Sequence
  Synthetic polypeptide
atgctacccattatcttctaaatggccttcagaaatgatggagaaactgacacgttatgagtatttcctgccctacatggattttgaacttgaattcccagcctcgcttgcatctagacacaggcacgtgacccaagccccaccagtcagacaaacccaattgaaactttagttcaaaagc

SEQ ID NO: 5322 - DNA, 374 bp, Artificial Sequence
  Synthetic polypeptide
atgtgtaaaatggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatatctacttgtctcattcccttaactacactcgaacttaagcatcagcttctccgtgaggccccctgaccatcctgtctccaataatatctctcctgggattggaccctcaccacccc

SEQ ID NO: 5323 - DNA, 464 bp, Artificial Sequence
  Synthetic polypeptide
atggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatatctacttgtctcattcccttaactacactcgaacttaagcatcagcttctccgtgaggccccctgaccatcctgtctccaataatatctctcctgggattggaccctcaccacccc

SEQ ID NO: 5324 - DNA, 3992 bp, Artificial Sequence; identical to SEQ ID NO: 120
  Synthetic polypeptide

SEQ ID NO: 5325 - DNA, 3845 bp, Artificial Sequence; identical to SEQ ID NO: 121
  Synthetic polypeptide

SEQ ID NO: 5326 - DNA, 285 bp, Artificial Sequence; identical to SEQ ID NO: 4104
  Synthetic polypeptide

SEQ ID NO: 5327 - DNA, 370 bp, Artificial Sequence; identical to SEQ ID NO: 4105
  Synthetic polypeptide

SEQ ID NO: 5328 - DNA, 250 bp, Artificial Sequence; identical to SEQ ID NO: 4106
  Synthetic polypeptide

SEQ ID NO: 5329 - DNA, 400 bp, Artificial Sequence; identical to SEQ ID NO: 4107
  Synthetic polypeptide

SEQ ID NO: 5330 - DNA, 403 bp, Artificial Sequence; identical to SEQ ID NO: 4108
  Synthetic polypeptide

SEQ ID NO: 5331 - DNA, 270 bp, Artificial Sequence
  Synthetic polypeptide
atggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagtggtacccctagaggtttgctgtgac

SEQ ID NO: 5332 - DNA, 255 bp, Artificial Sequence
  Synthetic polypeptide
atgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagtggtacccctagaggtttgctgtgac

SEQ ID NO: 5333 - DNA, 336 bp, Artificial Sequence
  Synthetic polypeptide
gacgtgttcctcatgatccggcgccacaagaccaccatcttcacggacgccaaggagtccagcacggtgttcgaactgaagcgcatcgtcgagggcatcctcaagcggcctcctgacgagcagcggctgtacaagttgctggtcagaagtctttgggacttgccccatgtagggcctctcccaagatcctgcttctctcctcaggatgaccaactcttggatgatggcaagacactgggcgagtgtggcttcaccagtcaaacagcacggccacaggccccagccacagtggggctggccttccgggcagtggtacccctagaggtttgctgtgac

SEQ ID NO: 5334 - DNA, 646 bp, Artificial Sequence; identical to SEQ ID NO: 5010
  Synthetic polypeptide

SEQ ID NO: 5335 - DNA, 47 bp, Artificial Sequence; identical to SEQ ID NO: 2014
  Synthetic polypeptide

SEQ ID NO: 5336 - DNA, 662 bp, Artificial Sequence; identical to SEQ ID NO: 4372
  Synthetic polypeptide

SEQ ID NO: 5337 - DNA, 281 bp, Artificial Sequence; identical to SEQ ID NO: 2021
  Synthetic polypeptide

SEQ ID NO: 5338 - DNA, 248 bp, Artificial Sequence; identical to SEQ ID NO: 2022
  Synthetic polypeptide

SEQ ID NO: 5339 - DNA, 1487 bp, Artificial Sequence; identical to SEQ ID NO: 2023
  Synthetic polypeptide

SEQ ID NO: 5340 - DNA, 1538 bp, Artificial Sequence; identical to SEQ ID NO: 2024
  Synthetic polypeptide

SEQ ID NO: 5341 - DNA, 1427 bp, Artificial Sequence; identical to SEQ ID NO: 2025
  Synthetic polypeptide

SEQ ID NO: 5342 - DNA, 568 bp, Artificial Sequence; identical to SEQ ID NO: 1967
  Synthetic polypeptide

SEQ ID NO: 5343 - DNA, 379 bp, Artificial Sequence; identical to SEQ ID NO: 1968
  Synthetic polypeptide

SEQ ID NO: 5344 - DNA, 3308 bp, Artificial Sequence; identical to SEQ ID NO: 428
  Synthetic polypeptide

SEQ ID NO: 5345 - DNA, 3203 bp, Artificial Sequence; identical to SEQ ID NO: 429
  Synthetic polypeptide

SEQ ID NO: 5346 - DNA, 2849 bp, Artificial Sequence; identical to SEQ ID NO: 430
  Synthetic polypeptide

SEQ ID NO: 5347 - DNA, 388 bp, Artificial Sequence; identical to SEQ ID NO: 431
  Synthetic polypeptide

SEQ ID NO: 5348 - DNA, 335 bp, Artificial Sequence; identical to SEQ ID NO: 2120
  Synthetic polypeptide

SEQ ID NO: 5349 - DNA, 128 bp, Artificial Sequence; identical to SEQ ID NO: 144
  Synthetic polypeptide

SEQ ID NO: 5350 - DNA, 128 bp, Artificial Sequence; identical to SEQ ID NO: 1082
  Synthetic polypeptide

SEQ ID NO: 5351 - DNA, 1563 bp, Artificial Sequence; identical to SEQ ID NO: 2008
  Synthetic polypeptide

SEQ ID NO: 5352 - DNA, 3908 bp, Artificial Sequence
  Synthetic polypeptide
atgaaaatacttgtggcatttctggtggtgctgaccatctttgggatacaatctcatggatacgaggtttttaacatcatcagcccaagcaacaatggtggcaatgttcaggagacagtgacaattgataatgaaaaaaataccgccatcattaacatccatgcaggatcatgctcttctaccacaatttttgactataaacatggctacattgcatccagggtgctctcccgaagagcctgctttatcctgaagatggaccatcagaacatccctcctctgaacaatctccaatggtacatctatgagaaacaggctctggacaacatgttctccagcaaatacacctgggtcaagtacaaccctctggagtctctgatcaaagacgtggattggttcctgcttgggtcacccattgagaaactctgcaaacatatccctttgtataagggggaagtggttgaaaacacacacctctgggatcctagctgcagaggacccccggcctccgcgtttgagctgacatgagactctcactagagattagatggagaaagggctccagcaggcacggagctggaagctttgtctgtgagacagctccgcgggagcactcatcccccagggctctctgtctccctctgagaggctctggccccatataaccaccagaatgggagaagaagtgcttccccgtgggattagggcacatctgtcccgcaggcccacctgcctgccagtccctcccaggattcctgcctggccaccccacaggagtgtgtacacagtgcagcctcagctgctcagcatgggtgctttgctccacttgagtgcattccggcagcgtgggagctgtttgaatcccccagtgcacacagatcccaaccccaagggtccaggggagggagctgtgagcagatccggacgtcccagggctgtggctccggagtgcggaactgggcccagtgcttcagcagaagaggagcccatactctcagaaaactctcagagaggggtgagtcgcacaggttcctgggctggtgtggaacctaggcgtgcctccctccacagagctggtccagtaagtgtggggcctgtctccctgctggacctctgcctgaaggagcccaacgacctggaacacctaacaacaacagaaagtcacggccacagtgccagtgatcaggggtccctcccctcaagaccgaggaggagacctggtgaggggtcacccctctcccccttgcaccacagagcacggcttcaaaggcccggatacacaaaggagccgggtggcagaatattagtctagctatctcccattgctctcacgcgccatctactggatttcatcccaaactacaacacgaaaaactgctaattttcctgcctgccaggccgaggactggaattcaacagactgtttagagcctttgccctctgaaaacttccagaaatgaagccaactgactatattcagtttacaccagagttaaaggaacgccaaccctcccagatgagaaagaatcagtgcaagaactgtagcaatttaaaaaaccagagcgtccccttacctccaaatgagcccactagctccacagcaattgttcttaaccaatctgaaatgatgagcatggaattcagaatctgaatggcaatgaagcttatagatatccaggagaaagttgaaatgcaatccaaggaaaccaagcaatccagtgaaatggtttaagagctgaaagataaaatagcaattttacaaaagacccaaactgagcttattgagttcaaaaaagaatttcataatacaatcagaagtattaatagcagaataggccaagctgaggaaagaatctcagagcttgacccctggttctttgaatcaacttagacaaaaataaagaaaaaagagttttaagaaatgaacacaatctcccagaaatatgagattatgtaaagagacaaaatctatgactcattgccatccctgagagagaaggagagagaataagcaacttggaaaatatatttggggacatagcccacaaaaatttccctaatctctctagagaggttgacatgtaaattcaagaaatacagaagaccttggccagataatatacaagatgaccatccccaaggcacatagtcatcagattcaccatggtcaatgcaaaagaaaaaaatcttaaagacagctagggagaagggtcaagtcacatgcagaaggactctcattaggctggcagtggacctctcagcagaaacctgacaagccagaagagatggagggagaggggtctatttttgtcatccttaaagaaaaaaaattccaaccaagagtctcatacactgccaaactaagcttcctaagtgaaggagaaataaaaaccttctcagacaagcaaatgctgaaggaattcaactagaccagcctaacaagaggtcctaagggagtgctgaatatggactcaaaagaataacacctgctaccacaaacactcacttaagcacacagcccaacgacactataggcaattacacagtaagtctacataacaacacaatgacaggatcaacatctcacacatcaatactaaccccgagtgtaaaggggctaaatgccccacttaaaagacatagagtgtcaagcttgataaaaagacaagatccaatcatccactattttcaagagctctatgttatgtgtaatgacacccacagactcaaagacttggagaaagatttatcatgcaaaatcagaaaacaaaaaagagcaggagtcactagttttatatcagacaaaacagactttaaacccttaataattaagaaagacaaagaagggtatttcctggaccacagaaggcttattggaaaaaaggacataatgacaaagggtacaatccaacaagaagttttaactattctaaatatatacacacccaacattggagcacccagatttataaaacaagtacttctcgatctacaagaagacttagacagccacacaataatagtgggagactttcacatcctacttacagatcattgagacagaaaactaataaaagaactctggacttaaacttgttacttgaccaattggacctaatagatatccacagaaaacttcacccaacaaagacagaatatacattcttcttatctgcacatggaacacattccaagatcaatcacatgctaggtaagaaagcaagtctcaataaattaaaaaaaattgaaatcatacgaaccttaatatcagaccacaatgtaattaaaaataaatcaatatcaagaagatctcatacataaatacatgaaaattaaacaacttactcctgaataactcttgtgtgaacatcaaaattcaggaagaaataaaaaattatttgaaattactaaaaatagagacataccttaccaaaatctctggggtacagctaaagcagtgttaagaggaaagtttatagcactaaatgccttaatcaagaagttaggaagatctcaaattagcagtctaactttgcatctaaaagaactagacagaaaagaacaaaccaaccccaaagctagcagaataaaagaagtcactaaagttagagaagaatggaatgaaattgagatgcaaaatccatacaaaagatcaaatgaaaccaatagttgtttctttgaaagaataaataaaattgatagacccacctagctagatgaacaaaaaagaaagatccaaataaacacaatcagaaatgacaaaggtgatgttacaattgatccacagaaatacttgtcctcagagactgctatgaacgtacacaaattagaaaatatagaggaaatggataaattcctgaaagcaaaaaatctcccaagattgaatagatgtgaaaattctcaacaaa

SEQ ID NO: 5353 - DNA, 212 bp, Artificial Sequence; identical to SEQ ID NO: 2100
  Synthetic polypeptide

SEQ ID NO: 5354 - DNA, 509 bp, Artificial Sequence
  Synthetic polypeptide
atggccccgcggcgggcgcgcggctgccggaccctcggtctcccggcgctgctactgctgctgctgctccggccgccggcgacgcgggatgcaagagacaggctggctgtcctggcgggaaggagcagaatatctgaaagcttcaaccatgaggtccagacacacgaggcctgcgtgagactcaggacaatggaaaactgcccccagtgccaccaccatcggacaagcaggcagcaagcaggtagcacagccatctatcatggagggcaggatggggtgggcaagtgtggagaaataacactctgtggtttaggcaggtagagaaggacagaagatcagtgtggagcagaacatggagaaaaagcctctgacactccagcaccagatagcaccagaggcctcaaagccagtggggctctgcaggtaaccatagcaacagcagcatccaaatccacctcaacaacttgtgagatcgactccatctctcacgccatcagcttagcagaaga

SEQ ID NO: 5355 - DNA, 258 bp, Artificial Sequence; identical to SEQ ID NO: 265
  Synthetic polypeptide

SEQ ID NO: 5356 - DNA, 243 bp, Artificial Sequence; identical to SEQ ID NO: 267
  Synthetic polypeptide

SEQ ID NO: 5357 - DNA, 324 bp, Artificial Sequence; identical to SEQ ID NO: 268
  Synthetic polypeptide

SEQ ID NO: 5358 - DNA, 586 bp, Artificial Sequence; identical to SEQ ID NO: 401
  Synthetic polypeptide

SEQ ID NO: 5359 - DNA, 829 bp, Artificial Sequence; identical to SEQ ID NO: 402
  Synthetic polypeptide

SEQ ID NO: 5360 - DNA, 1060 bp, Artificial Sequence; identical to SEQ ID NO: 403
  Synthetic polypeptide

SEQ ID NO: 5361 - DNA, 730 bp, Artificial Sequence; identical to SEQ ID NO: 406
  Synthetic polypeptide

SEQ ID NO: 5362 - DNA, 496 bp, Artificial Sequence; identical to SEQ ID NO: 408
  Synthetic polypeptide

SEQ ID NO: 5363 - DNA, 679 bp, Artificial Sequence; identical to SEQ ID NO: 1729
  Synthetic polypeptide

SEQ ID NO: 5364 - DNA, 840 bp, Artificial Sequence; identical to SEQ ID NO: 1937
  Synthetic polypeptide

SEQ ID NO: 5365 - DNA, 559 bp, Artificial Sequence; identical to SEQ ID NO: 1701
  Synthetic polypeptide

SEQ ID NO: 5366 - DNA, 307 bp, Artificial Sequence; identical to SEQ ID NO: 2622
  Synthetic polypeptide

SEQ ID NO: 5367 - DNA, 2154 bp, Artificial Sequence
  Synthetic polypeptide
atggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgcaaggcccatcttttgcctacggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggcccaggacttcgaggctgcaatgagctataattgcatcattgcactccagcctgggcaacagagaccctgtctca

SEQ ID NO: 5368 - DNA, 2133 bp, Artificial Sequence
  Synthetic polypeptide
atggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggcccaggacttcgaggctgcaatgagctataattgcatcattgcactccagcctgggcaacagagaccctgtctca

SEQ ID NO: 5369 - DNA, 163 bp, Artificial Sequence; identical to SEQ ID NO: 4202
  Synthetic polypeptide

SEQ ID NO: 5370 - DNA, 1394 bp, Artificial Sequence; identical to SEQ ID NO: 1118
  Synthetic polypeptide

SEQ ID NO: 5371 - DNA, 1625 bp, Artificial Sequence; identical to SEQ ID NO: 1119
  Synthetic polypeptide

SEQ ID NO: 5372 - DNA, 1505 bp, Artificial Sequence; identical to SEQ ID NO: 1120
  Synthetic polypeptide

SEQ ID NO: 5373 - DNA, 1562 bp, Artificial Sequence; identical to SEQ ID NO: 1121
  Synthetic polypeptide

SEQ ID NO: 5374 - DNA, 1601 bp, Artificial Sequence; identical to SEQ ID NO: 1122
  Synthetic polypeptide

SEQ ID NO: 5375 - DNA, 1631 bp, Artificial Sequence; identical to SEQ ID NO: 1123
  Synthetic polypeptide

SEQ ID NO: 5376 - DNA, 938 bp, Artificial Sequence; identical to SEQ ID NO: 2101
  Synthetic polypeptide

SEQ ID NO: 5377 - DNA, 55 bp, Artificial Sequence; identical to SEQ ID NO: 291
  Synthetic polypeptide

SEQ ID NO: 5378 - DNA, 25 bp, Artificial Sequence
  Synthetic polypeptide
atgagcgtcctttcgtttttttaaa

SEQ ID NO: 5379 - DNA, 341 bp, Artificial Sequence
  Synthetic polypeptide
atggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacgaaaccatggagaccagaagtgtgatgaacctcgcatgtgatggaagaaaacaccccatcaattcaagttctctactccctggaaatgtttctcaggtataaagatgaaatcaagacgtgaccagacagacagaacttgagagactccatcaacagatgactcttaggaaaagacagac

SEQ ID NO: 5380 - DNA, 410 bp, Artificial Sequence
  Synthetic polypeptide
atggctgtggaatctgaatattcactgctgagaaccgaagccagctttcctactatgaagatgttctgtgtgagccacaccttgcccagggtggaagtgatgtttgtttcaggtccacagacgagggagaggacggagccagtggaccctcggtggcagtgtctggtgcagatgtgggcaggctgcctgctcgaggagggcctctgcggagcgtccgaggcctgtgtgaacgaaaccatggagaccagaagtgtgatgaacctcgcatgtgatggaagaaaacaccccatcaattcaagttctctactccctggaaatgtttctcaggtataaagatgaaatcaagacgtgaccagacagacagaacttgagagactccatcaacagatgactcttaggaaaagacagac

SEQ ID NO: 5381 - DNA, 304 bp, Artificial Sequence
  Synthetic polypeptide
atggcagagaatcacgcccagaataaagccaagctcatctctgagacccggaggaggttcgaagctgagtatgtgacagggacatggatgaagctggaaaccatcattctgagcaaactatggcaaggacagaaaaccaaacaccgcatgttctcactcataggtgggaattgaacaatgagaacacttggacacagggtggggaacatcacacaccagggcctggcatggggtgggggaaggggggagggatagcattaggagatatacctaatgtaaatgacgagttaatgggtgcagcata

SEQ ID NO: 5382 - DNA, 1400 bp, Artificial Sequence; identical to SEQ ID NO: 2146
  Synthetic polypeptide

SEQ ID NO: 5383 - DNA, 1403 bp, Artificial Sequence; identical to SEQ ID NO: 2147
  Synthetic polypeptide

SEQ ID NO: 5384 - DNA, 1273 bp, Artificial Sequence; identical to SEQ ID NO: 2173
  Synthetic polypeptide

SEQ ID NO: 5385 - DNA, 763 bp, Artificial Sequence; identical to SEQ ID NO: 261
  Synthetic polypeptide

SEQ ID NO: 5386 - DNA, 646 bp, Artificial Sequence; identical to SEQ ID NO: 262
  Synthetic polypeptide

SEQ ID NO: 5387 - DNA, 1166 bp, Artificial Sequence; identical to SEQ ID NO: 2201
  Synthetic polypeptide

SEQ ID NO: 5388 - DNA, 1061 bp, Artificial Sequence; identical to SEQ ID NO: 2202
  Synthetic polypeptide

SEQ ID NO: 5389 - DNA, 4191 bp, Artificial Sequence; identical to SEQ ID NO: 2054
  Synthetic polypeptide

SEQ ID NO: 5390 - DNA, 24 bp, Artificial Sequence
  Synthetic polypeptide
atggaagccttccctgactgccta

SEQ ID NO: 5391 - DNA, 1312 bp, Artificial Sequence; identical to SEQ ID NO: 4315
  Synthetic polypeptide

SEQ ID NO: 5392 - DNA, 1069 bp, Artificial Sequence; identical to SEQ ID NO: 4316
  Synthetic polypeptide

SEQ ID NO: 5393 - DNA, 1132 bp, Artificial Sequence; identical to SEQ ID NO: 4317
  Synthetic polypeptide

SEQ ID NO: 5394 - DNA, 1181 bp, Artificial Sequence; identical to SEQ ID NO: 1730
  Synthetic polypeptide

SEQ ID NO: 5395 - DNA, 983 bp, Artificial Sequence; identical to SEQ ID NO: 1731
  Synthetic polypeptide

SEQ ID NO: 5396 - DNA, 1148 bp, Artificial Sequence; identical to SEQ ID NO: 1732
  Synthetic polypeptide

SEQ ID NO: 5397 - DNA, 442 bp, Artificial Sequence; identical to SEQ ID NO: 1723
  Synthetic polypeptide

SEQ ID NO: 5398 - DNA, 609 bp, Artificial Sequence; identical to SEQ ID NO: 249
  Synthetic polypeptide

SEQ ID NO: 5399 - DNA, 738 bp, Artificial Sequence; identical to SEQ ID NO: 250
  Synthetic polypeptide

SEQ ID NO: 5400 - DNA, 537 bp, Artificial Sequence; identical to SEQ ID NO: 251
  Synthetic polypeptide

SEQ ID NO: 5401 - DNA, 684 bp, Artificial Sequence; identical to SEQ ID NO: 253
  Synthetic polypeptide

SEQ ID NO: 5402 - DNA, 285 bp, Artificial Sequence; identical to SEQ ID NO: 255
  Synthetic polypeptide

SEQ ID NO: 5403 - DNA, 552 bp, Artificial Sequence; identical to SEQ ID NO: 254
  Synthetic polypeptide

SEQ ID NO: 5404 - DNA, 4277 bp, Artificial Sequence; identical to SEQ ID NO: 2069
  Synthetic polypeptide

SEQ ID NO: 5405 - DNA, 572 bp, Artificial Sequence; identical to SEQ ID NO: 159
  Synthetic polypeptide

SEQ ID NO: 5406 - DNA, 466 bp, Artificial Sequence; identical to SEQ ID NO: 2137
  Synthetic polypeptide

SEQ ID NO: 5407 - DNA, 102 bp, Artificial Sequence; identical to SEQ ID NO: 258
  Synthetic polypeptide

SEQ ID NO: 5408 - DNA, 82 bp, Artificial Sequence; identical to SEQ ID NO: 257
  Synthetic polypeptide

SEQ ID NO: 5409 - DNA, 776 bp, Artificial Sequence
  Synthetic polypeptide
atgaaaacgctccttcttttgctgctggtgctcctggagctgggagaggcccaaggatcccttcacagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgttccagatcgcaatgtgaaaagtaaacaataaagcttttagaagaaaacatgagaaaatgttttcatgaccttaaggtaggcaaaattttctgaaacaagttacaaaaaaacagtgtacaataagcacatgatgagtgacagaagccagataccaaagagttcatatgggatgattccatttatataaaatccaaaaaataggcaaaaccaatatatgttattagaagtcaggagactggctcttcttgaggaggggcgcaatgattggcaggtgcatgagggcttctgaggtttggaatgtcctgttttttg

SEQ ID NO: 5410 - DNA, 551 bp, Artificial Sequence
  Synthetic polypeptide
atggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgttccagatcgcaatgtgaaaagtaaacaataaagcttttagaagaaaacatgagaaaatgttttcatgaccttaaggtaggcaaaattttctgaaacaagttacaaaaaaacagtgtacaataagcacatgatgagtgacagaagccagataccaaagagttcatatgggatgattccatttatataaaatccaaaaaataggcaaaaccaatatatgttattagaagtcaggagactggctcttcttgaggaggggcgcaatgattggcaggtgcatgagggcttctgaggtttggaatgtcctgttttttg

SEQ ID NO: 5411 - DNA, 104 bp, Artificial Sequence
  Synthetic polypeptide
atggccccgcgcgcccggcggcgccgcccgctgttcgcgctgctgctgctctgcgcgctgctcgcccggctgcaggtgattctgcgcacattggagaagcactg

SEQ ID NO: 5412 - DNA, 1412 bp, Artificial Sequence; identical to SEQ ID NO: 2038
  Synthetic polypeptide

SEQ ID NO: 5413 - DNA, 2713 bp, Artificial Sequence; identical to SEQ ID NO: 1273
  Synthetic polypeptide

SEQ ID NO: 5414 - DNA, 228 bp, Artificial Sequence; identical to SEQ ID NO: 1274
  Synthetic polypeptide

SEQ ID NO: 5415 - DNA, 1372 bp, Artificial Sequence; identical to SEQ ID NO: 1756
  Synthetic polypeptide

SEQ ID NO: 5416 - DNA, 1032 bp, Artificial Sequence; identical to SEQ ID NO: 1790
  Synthetic polypeptide

SEQ ID NO: 5417 - DNA, 289 bp, Artificial Sequence; identical to SEQ ID NO: 1791
  Synthetic polypeptide

SEQ ID NO: 5418 - DNA, 1314 bp, Artificial Sequence; identical to SEQ ID NO: 1792
  Synthetic polypeptide

SEQ ID NO: 5419 - DNA, 620 bp, Artificial Sequence; identical to SEQ ID NO: 1793
  Synthetic polypeptide

SEQ ID NO: 5420 - DNA, 1313 bp, Artificial Sequence
  Synthetic polypeptide
atggtgttcgcattttggaaggtctttctgatcctaagctgccttgcaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctcacagctcgtgcctcagtactgagggtatggaggaaaaggcagtcagtcagtgtctaaaaatgacgcacgcaagagacgctcggggaagatgtagctggacctctgagatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgcagtgagccgagattgtgccactgcactccaacctgggtgacagagtgagattccatctgaaaaacaaaaacaaaaacagaaaacaaa

SEQ ID NO: 5421 - DNA, 1205 bp, Artificial Sequence
  Synthetic polypeptide
atggtgttcgcattttggaaggtctttctgatcctaagctgccttgcaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgcagtgagccgagattgtgccactgcactccaacctgggtgacagagtgagattccatctgaaaaacaaaaacaaaaacagaaaacaaa

SEQ ID NO: 5422 - DNA, 1143 bp, Artificial Sequence
  Synthetic polypeptide
atgttctccaacgcaaacagcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagccttgctattcagagcatggtttggagccaatggcatcagcatcacctatgaatgcagaatctcaggctgttccccagatctactgaaacagaatttttacttcaacaagatcttcaggtaattcacaggcccattagaatttgacaagcact

SEQ ID NO: 5423 - DNA, 1014 bp, Artificial Sequence
  Synthetic polypeptide
atgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagccttgctattcagagcatggtttggagccaatggcatcagcatcacctatgaatgcagaatctcaggctgttccccagatctactgaaacagaatttttacttcaacaagatcttcaggtaattcacaggcccattagaatttgacaagcact

SEQ ID NO: 5424 - DNA, 1113 bp, Artificial Sequence
  Synthetic polypeptide
atgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagccttgctattcagagcatggtttggagccaatggcatcagcatcacctatgaatgcagaatctcaggctgttccccagatctactgaaacagaatttttacttcaacaagatcttcaggtaattcacaggcccattagaatttgacaagcact

SEQ ID NO: 5425 - DNA, 1044 bp, Artificial Sequence
  Synthetic polypeptide
atgttctccaacgcaaacagcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagccttgctattcagagcatggtttggagccaatggcatcagcatcacctatgaatgcagaatctcaggctgttccccagatctactgaaacagaatttttacttcaacaagatcttcaggtaattcacaggcccattagaatttgacaagcact

SEQ ID NO: 5426 - DNA, 1041 bp, Artificial Sequence; identical to SEQ ID NO: 2160
  Synthetic polypeptide

SEQ ID NO: 5427 - DNA, 987 bp, Artificial Sequence; identical to SEQ ID NO: 2161
  Synthetic polypeptide

SEQ ID NO: 5428 - DNA, 1089 bp, Artificial Sequence; identical to SEQ ID NO: 2162
  Synthetic polypeptide

SEQ ID NO: 5429 - DNA, 678 bp, Artificial Sequence; identical to SEQ ID NO: 2163
  Synthetic polypeptide

SEQ ID NO: 5430 - DNA, 299 bp, Artificial Sequence; identical to SEQ ID NO: 1033
  Synthetic polypeptide

SEQ ID NO: 5431 - DNA, 191 bp, Artificial Sequence; identical to SEQ ID NO: 1034
  Synthetic polypeptide

SEQ ID NO: 5432 - DNA, 644 bp, Artificial Sequence; identical to SEQ ID NO: 2138
  Synthetic polypeptide

SEQ ID NO: 5433 - DNA, 255 bp, Artificial Sequence; identical to SEQ ID NO: 2139
  Synthetic polypeptide

SEQ ID NO: 5434 - DNA, 3723 bp, Artificial Sequence; identical to SEQ ID NO: 1743
  Synthetic polypeptide

SEQ ID NO: 5435 - DNA, 3708 bp, Artificial Sequence; identical to SEQ ID NO: 1744
  Synthetic polypeptide

SEQ ID NO: 5436 - DNA, 3333 bp, Artificial Sequence; identical to SEQ ID NO: 1745
  Synthetic polypeptide

SEQ ID NO: 5437 - DNA, 193 bp, Artificial Sequence; identical to SEQ ID NO: 1992
  Synthetic polypeptide

SEQ ID NO: 5438 - DNA, 312 bp, Artificial Sequence; identical to SEQ ID NO: 1728
  Synthetic polypeptide

SEQ ID NO: 5439 - DNA, 520 bp, Artificial Sequence; identical to SEQ ID NO: 1727
  Synthetic polypeptide

SEQ ID NO: 5440 - DNA, 690 bp, Artificial Sequence; identical to SEQ ID NO: 145
  Synthetic polypeptide

SEQ ID NO: 5441 - DNA, 516 bp, Artificial Sequence; identical to SEQ ID NO: 5236
  Synthetic polypeptide

SEQ ID NO: 5442 - DNA, 2731 bp, Artificial Sequence
  Synthetic polypeptide
atggggtggcgggcggcgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagttccgagaggtgtccgaggctgtggtagacacgctggagtcggagtacttgaaaattcccggagaccaggttgtcagtgtggtgttcatcaaggagctggatggctgggtttttgtggagctggatgtgggctcggaagggaatgcggatggggctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccacccccatcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcatgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggccagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcaattgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaaggcaacaagactgaaactccgtctcaaaaaaaaaaaaaaaaaaagaa

SEQ ID NO: 5443 - DNA, 3881 bp, Artificial Sequence; identical to SEQ ID NO: 1162
  Synthetic polypeptide

SEQ ID NO: 5444 - DNA, 3722 bp, Artificial Sequence; identical to SEQ ID NO: 1163
  Synthetic polypeptide

SEQ ID NO: 5445 - DNA, 410 bp, Artificial Sequence; identical to SEQ ID NO: 2072
  Synthetic polypeptide

SEQ ID NO: 5446 - DNA, 188 bp, Artificial Sequence; identical to SEQ ID NO: 2073
  Synthetic polypeptide

SEQ ID NO: 5447 - DNA, 1091 bp, Artificial Sequence; identical to SEQ ID NO: 2032
  Synthetic polypeptide

SEQ ID NO: 5448 - DNA, 728 bp, Artificial Sequence; identical to SEQ ID NO: 269
  Synthetic polypeptide

SEQ ID NO: 5449 - DNA, 663 bp, Artificial Sequence; identical to SEQ ID NO: 271
  Synthetic polypeptide

SEQ ID NO: 5450 - DNA, 1052 bp, Artificial Sequence; identical to SEQ ID NO: 247
  Synthetic polypeptide

SEQ ID NO: 5451 - DNA, 327 bp, Artificial Sequence; identical to SEQ ID NO: 246
  Synthetic polypeptide

SEQ ID NO: 5452 - DNA, 92 bp, Artificial Sequence; identical to SEQ ID NO: 1765
  Synthetic polypeptide

SEQ ID NO: 5453 - DNA, 169 bp, Artificial Sequence; identical to SEQ ID NO: 4125
  Synthetic polypeptide

SEQ ID NO: 5454 - DNA, 2161 bp, Artificial Sequence; identical to SEQ ID NO: 288
  Synthetic polypeptide

SEQ ID NO: 5455 - DNA, 2140 bp, Artificial Sequence; identical to SEQ ID NO: 289
  Synthetic polypeptide

SEQ ID NO: 5456 - DNA, 529 bp, Artificial Sequence; identical to SEQ ID NO: 287
  Synthetic polypeptide

SEQ ID NO: 5457 - DNA, 47 bp, Artificial Sequence; identical to SEQ ID NO: 2074
  Synthetic polypeptide

SEQ ID NO: 5458 - DNA, 775 bp, Artificial Sequence; identical to SEQ ID NO: 215
  Synthetic polypeptide

SEQ ID NO: 5459 - DNA, 1396 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggagaatcgcttgaacccgggaggtggagattgcagtgagcccagatcgcaccactgcactccagtctggcaacagagcaagactccatctcaaaaagaaaagaaaagaa

SEQ ID NO: 5460 - DNA, 1399 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggagaatcgcttgaacccgggaggtggagattgcagtgagcccagatcgcaccactgcactccagtctggcaacagagcaagactccatctcaaaaagaaaagaaaagaa

SEQ ID NO: 5461 - DNA, 2849 bp, Artificial Sequence; identical to SEQ ID NO: 1326
  Synthetic polypeptide

SEQ ID NO: 5462 - DNA, 1925 bp, Artificial Sequence; identical to SEQ ID NO: 1327
  Synthetic polypeptide

SEQ ID NO: 5463 - DNA, 2729 bp, Artificial Sequence; identical to SEQ ID NO: 1328
  Synthetic polypeptide

SEQ ID NO: 5464 - DNA, 2549 bp, Artificial Sequence; identical to SEQ ID NO: 1329
  Synthetic polypeptide

SEQ ID NO: 5465 - DNA, 366 bp, Artificial Sequence; identical to SEQ ID NO: 1772
  Synthetic polypeptide

SEQ ID NO: 5466 - DNA, 479 bp, Artificial Sequence; identical to SEQ ID NO: 4381
  Synthetic polypeptide

SEQ ID NO: 5467 - DNA, 4120 bp, Artificial Sequence; identical to SEQ ID NO: 1356
  Synthetic polypeptide

SEQ ID NO: 5468 - DNA, 4132 bp, Artificial Sequence; identical to SEQ ID NO: 1357
  Synthetic polypeptide

SEQ ID NO: 5469 - DNA, 4120 bp, Artificial Sequence; identical to SEQ ID NO: 1358
  Synthetic polypeptide

SEQ ID NO: 5470 - DNA, 4024 bp, Artificial Sequence; identical to SEQ ID NO: 1359
  Synthetic polypeptide

SEQ ID NO: 5471 - DNA, 4531 bp, Artificial Sequence; identical to SEQ ID NO: 1360
  Synthetic polypeptide

SEQ ID NO: 5472 - DNA, 4054 bp, Artificial Sequence; identical to SEQ ID NO: 1361
  Synthetic polypeptide

SEQ ID NO: 5473 - DNA, 4078 bp, Artificial Sequence; identical to SEQ ID NO: 1362
  Synthetic polypeptide

SEQ ID NO: 5474 - DNA, 4201 bp, Artificial Sequence; identical to SEQ ID NO: 1363
  Synthetic polypeptide

SEQ ID NO: 5475 - DNA, 4189 bp, Artificial Sequence; identical to SEQ ID NO: 1364
  Synthetic polypeptide

SEQ ID NO: 5476 - DNA, 210 bp, Artificial Sequence; identical to SEQ ID NO: 1365
  Synthetic polypeptide

SEQ ID NO: 5477 - DNA, 329 bp, Artificial Sequence
  Synthetic polypeptide
atggcccagccggtccacagcctctgctccgcctttggcctccagtgctgcctcctcttccttctagcttcttggggggcaggaggctgagatgagaggatcactgaagaccagagtttgagaccagcctggccaacatagtgagaccctgcgtcttaaaaaaaaaaaaaaaaaaaaggtgaggagggggcatactggctcacatttgtagtcccagctgacagggaggctgaggtgggggtactgcttgagcccaggaggtcaggactgcagtgagctgtgaccatgccactgcactccagcctggtgcagagtaagactctatctca

SEQ ID NO: 5478 - DNA, 3220 bp, Artificial Sequence; identical to SEQ ID NO: 248
  Synthetic polypeptide

SEQ ID NO: 5479 - DNA, 671 bp, Artificial Sequence; identical to SEQ ID NO: 4064
  Synthetic polypeptide

SEQ ID NO: 5480 - DNA, 186 bp, Artificial Sequence; identical to SEQ ID NO: 2172
  Synthetic polypeptide

SEQ ID NO: 5481 - DNA, 528 bp, Artificial Sequence
  Synthetic polypeptide
gcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggatcacttgacctcaggagttggagaccagcctgggcaacatggtgaaaccccatctctattttattaaaaaagaaaagaaagagaaaaa

SEQ ID NO: 5482 - DNA, 372 bp, Artificial Sequence; identical to SEQ ID NO: 1188
  Synthetic polypeptide

SEQ ID NO: 5483 - DNA, 1629 bp, Artificial Sequence; identical to SEQ ID NO: 2518
  Synthetic polypeptide

SEQ ID NO: 5484 - DNA, 843 bp, Artificial Sequence; identical to SEQ ID NO: 2205
  Synthetic polypeptide

SEQ ID NO: 5485 - DNA, 2153 bp, Artificial Sequence; identical to SEQ ID NO: 217
  Synthetic polypeptide

SEQ ID NO: 5486 - DNA, 1664 bp, Artificial Sequence; identical to SEQ ID NO: 222
  Synthetic polypeptide

SEQ ID NO: 5487 - DNA, 1766 bp, Artificial Sequence; identical to SEQ ID NO: 221
  Synthetic polypeptide

SEQ ID NO: 5488 - DNA, 1130 bp, Artificial Sequence
  Synthetic polypeptide
atgttctccaacgcaaacagcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagagcatggtttggagccaatggcatcagcatcacctatgaatgcagaatctcaggctgttccccagatctactgaaacagaatttttacttcaacaagatcttcaggtaattcacaggcccattagaatttgacaagcact

SEQ ID NO: 5489 - DNA, 1001 bp, Artificial Sequence
  Synthetic polypeptide
atgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagagcatggtttggagccaatggcatcagcatcacctatgaatgcagaatctcaggctgttccccagatctactgaaacagaatttttacttcaacaagatcttcaggtaattcacaggcccattagaatttgacaagcact

SEQ ID NO: 5490 - DNA, 1100 bp, Artificial Sequence
  Synthetic polypeptide
atgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagagcatggtttggagccaatggcatcagcatcacctatgaatgcagaatctcaggctgttccccagatctactgaaacagaatttttacttcaacaagatcttcaggtaattcacaggcccattagaatttgacaagcact

SEQ ID NO: 5491 - DNA, 1031 bp, Artificial Sequence
  Synthetic polypeptide
atgttctccaacgcaaacagcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagagcatggtttggagccaatggcatcagcatcacctatgaatgcagaatctcaggctgttccccagatctactgaaacagaatttttacttcaacaagatcttcaggtaattcacaggcccattagaatttgacaagcact

SEQ ID NO: 5492 - DNA, 1024 bp, Artificial Sequence; identical to SEQ ID NO: 4205
  Synthetic polypeptide

SEQ ID NO: 5493 - DNA, 970 bp, Artificial Sequence; identical to SEQ ID NO: 4206
  Synthetic polypeptide

SEQ ID NO: 5494 - DNA, 1072 bp, Artificial Sequence; identical to SEQ ID NO: 4207
  Synthetic polypeptide

SEQ ID NO: 5495 - DNA, 661 bp, Artificial Sequence; identical to SEQ ID NO: 4208
  Synthetic polypeptide

SEQ ID NO: 5496 - DNA, 5505 bp, Artificial Sequence; identical to SEQ ID NO: 1545
  Synthetic polypeptide

SEQ ID NO: 5497 - DNA, 5418 bp, Artificial Sequence; identical to SEQ ID NO: 1546
  Synthetic polypeptide

SEQ ID NO: 5498 - DNA, 1834 bp, Artificial Sequence; identical to SEQ ID NO: 133
  Synthetic polypeptide

SEQ ID NO: 5499 - DNA, 1765 bp, Artificial Sequence; identical to SEQ ID NO: 135
  Synthetic polypeptide

SEQ ID NO: 5500 - DNA, 610 bp, Artificial Sequence; identical to SEQ ID NO: 163
  Synthetic polypeptide

SEQ ID NO: 5501 - DNA, 1357 bp, Artificial Sequence; identical to SEQ ID NO: 3433
  Synthetic polypeptide

SEQ ID NO: 5502 - DNA, 107 bp, Artificial Sequence
  Synthetic polypeptide
atgttcgaagagcctgagtgggccgaggcggccccagtagccgcgggccttgggcccgtaatctcacgacctccgcctgcggcctcctcgcaaaacaagctttccag

SEQ ID NO: 5503 - DNA, 103 bp, Artificial Sequence; identical to SEQ ID NO: 173
  Synthetic polypeptide

SEQ ID NO: 5504 - DNA, 569 bp, Artificial Sequence; identical to SEQ ID NO: 1768
  Synthetic polypeptide

SEQ ID NO: 5505 - DNA, 497 bp, Artificial Sequence; identical to SEQ ID NO: 1769
  Synthetic polypeptide

SEQ ID NO: 5506 - DNA, 882 bp, Artificial Sequence
  Synthetic polypeptide
atgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgacaagagtggcagcgtggtgatctttggtggcattgactcttcttactacactggaagtctgaactgggtgcctgttaccgtcgagggttactggcagatcaccgtggacaggccgggagctccctgcagcctggaactgtgaggctgtcttgtttcgcttggcgtttcccatgcctggcagagggtaggcacttgggaaatatttgtagggtaaatgaat

SEQ ID NO: 5507 - DNA, 420 bp, Artificial Sequence
  Synthetic polypeptide
atggtaagtggaaacaacagtgacggtgcccactgcatgggccctggcctaagaggaaaagaaaccacattggtcacaccccaggacagccctggaaagtgcccaatcaacggtcgctctgaggaggcaacagcagatggtcacacaaatggacgaacaaaaaaattcatgtcttctcccctcactttccacagcgatgacaagagtggcagcgtggtgatctttggtggcattgactcttcttactacactggaagtctgaactgggtgcctgttaccgtcgagggttactggcagatcaccgtggacaggccgggagctccctgcagcctggaactgtgaggctgtcttgtttcgcttggcgtttcccatgcctggcagagggtaggcacttgggaaatatttgtagggtaaatgaat

SEQ ID NO: 5508 - DNA, 434 bp, Artificial Sequence; identical to SEQ ID NO: 3710
  Synthetic polypeptide

SEQ ID NO: 5509 - DNA, 689 bp, Artificial Sequence; identical to SEQ ID NO: 4459
  Synthetic polypeptide

SEQ ID NO: 5510 - DNA, 444 bp, Artificial Sequence
  Synthetic polypeptide
atggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaaggggaaaaccaactgccttttcacttgagctgtctagaaaggcccatgtagtgtggaactgaagcctttcaacaacagcaagtgtcaacttagaaccgtaagaatgagttaccttcaaaacacaccctccacgcccagtcaagccttcagataactgcagccttgaccaggtacagcctcttgagagattccaggcccacacgacttagctaagccactttccaattcttcaaccacatatgataaatacatgttattgttttaaggcactgagttttggggtattttgttacatagcaataattaa

SEQ ID NO: 5511 - DNA, 584 bp, Artificial Sequence; identical to SEQ ID NO: 4502
  Synthetic polypeptide

SEQ ID NO: 5512 - DNA, 623 bp, Artificial Sequence; identical to SEQ ID NO: 4503
  Synthetic polypeptide

SEQ ID NO: 5513 - DNA, 428 bp, Artificial Sequence; identical to SEQ ID NO: 4504
  Synthetic polypeptide

SEQ ID NO: 5514 - DNA, 2962 bp, Artificial Sequence; identical to SEQ ID NO: 2377
  Synthetic polypeptide

SEQ ID NO: 5515 - DNA, 2899 bp, Artificial Sequence; identical to SEQ ID NO: 2378
  Synthetic polypeptide

SEQ ID NO: 5516 - DNA, 2902 bp, Artificial Sequence; identical to SEQ ID NO: 2379
  Synthetic polypeptide

SEQ ID NO: 5517 - DNA, 2839 bp, Artificial Sequence; identical to SEQ ID NO: 2380
  Synthetic polypeptide

SEQ ID NO: 5518 - DNA, 645 bp, Artificial Sequence; identical to SEQ ID NO: 137
  Synthetic polypeptide

SEQ ID NO: 5519 - DNA, 856 bp, Artificial Sequence
  Synthetic polypeptide
atgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttca

SEQ ID NO: 5520 - DNA, 1721 bp, Artificial Sequence; identical to SEQ ID NO: 1726
  Synthetic polypeptide

SEQ ID NO: 5521 - DNA, 665 bp, Artificial Sequence; identical to SEQ ID NO: 2195
  Synthetic polypeptide

SEQ ID NO: 5522 - DNA, 1151 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtggagattgcagtgagcccagatcgcaccactgcactccagtctggcaacagagcaagactccatctcaaaaagaaaagaaaagaa

SEQ ID NO: 5523 - DNA, 1154 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtggagattgcagtgagcccagatcgcaccactgcactccagtctggcaacagagcaagactccatctcaaaaagaaaagaaaagaa

SEQ ID NO: 5524 - DNA, 601 bp, Artificial Sequence
  Synthetic polypeptide
taatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctcagagccacccaaacccttcatcaccagcaacaactccaaccccgtggaggatgaggatgctgtagccttaacctgtgaacctgagattcagaacacaacctacctgtggtggagattgcagtgagcccagatcgcaccactgcactccagtctggcaacagagcaagactccatctcaaaaagaaaagaaaagaa

SEQ ID NO: 5525 - DNA, 1041 bp, Artificial Sequence; identical to SEQ ID NO: 969
  Synthetic polypeptide

SEQ ID NO: 5526 - DNA, 195 bp, Artificial Sequence; identical to SEQ ID NO: 4558
  Synthetic polypeptide

SEQ ID NO: 5527 - DNA, 808 bp, Artificial Sequence
  Synthetic polypeptide
atgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgcc

SEQ ID NO: 5528 - DNA, 91 bp, Artificial Sequence; identical to SEQ ID NO: 223
  Synthetic polypeptide

SEQ ID NO: 5529 - DNA, 415 bp, Artificial Sequence; identical to SEQ ID NO: 4339
  Synthetic polypeptide

SEQ ID NO: 5530 - DNA, 1184 bp, Artificial Sequence
  Synthetic polypeptide
gcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgacagagacggccggcaaagcccagcagcaaggagagagcctgggacagagtctcccatgacacagaggtgccagccccgccgaggcctccatcccagatgcccggcctccagaaccaggacggaataaacgtctgttgtttaagccacgcagtctggggtgctgtgttgccagggccacagttaacggatac

SEQ ID NO: 5531 - DNA, 1079 bp, Artificial Sequence
  Synthetic polypeptide
gcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgacagagacggccggcaaagcccagcagcaaggagagagcctgggacagagtctcccatgacacagaggtgccagccccgccgaggcctccatcccagatgcccggcctccagaaccaggacggaataaacgtctgttgtttaagccacgcagtctggggtgctgtgttgccagggccacagttaacggatac

SEQ ID NO: 5532 - DNA, 672 bp, Artificial Sequence
  Synthetic polypeptide
atggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccagacccttgctaattgaactgctcaaggatgtacttcaggaagaagaaaattgaacctaagatggaagaaataagatctaagaaggaatggtgagctaaataattgataagcatggggtaaatctaaataagcattgacttatttagtaataatgatgat

SEQ ID NO: 5533 - DNA, 245 bp, Artificial Sequence
  Synthetic polypeptide
atggagccgccgaatctctatccggtgaagctctacgtgtacgacctgtccaaaggcctggcccggcggctcagccccatcatgctggggaaacaactggaaggcatctgggaggaggatgctactggcatcttgtggatagaggcagggacgctgctcaacagactagaatgcacaggacagccccacacaacaaagaagtatccagcctcaaatgtcaatagtgccaagattgagaagccctg

SEQ ID NO: 5534 - DNA, 831 bp, Artificial Sequence; identical to SEQ ID NO: 4340
  Synthetic polypeptide

SEQ ID NO: 5535 - DNA, 848 bp, Artificial Sequence; identical to SEQ ID NO: 4341
  Synthetic polypeptide

SEQ ID NO: 5536 - DNA, 809 bp, Artificial Sequence; identical to SEQ ID NO: 4593
  Synthetic polypeptide

SEQ ID NO: 5537 - DNA, 836 bp, Artificial Sequence; identical to SEQ ID NO: 4594
  Synthetic polypeptide

SEQ ID NO: 5538 - DNA, 512 bp, Artificial Sequence; identical to SEQ ID NO: 4595
  Synthetic polypeptide

SEQ ID NO: 5539 - DNA, 525 bp, Artificial Sequence
  Synthetic polypeptide
atgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggatgccaatggagatgcccaggtggacttcagtgagttcatagtgttcgtggctgcaatcacgtctgcctttcacaagcactttgagaggctgaggcaggcggatcacaaggtcaggagatcgagaccatcctggctaacatggtgaaaccctgtctactaaaaatacaaaaaaaaaaaaaaaaaattagccaggcatggtggtgggcgcctgtggtcccagctactcaggaggctgtggcgggaaaatggtgtgaacccgggagtcggagcggagatgacgccactgcactccagccggggcgacagagcaagactctgtctgaaaaaaaagaaaaaagaa

SEQ ID NO: 5540 - DNA, 882 bp, Artificial Sequence
  Synthetic polypeptide
atgaagtggctgctgctgctgggtctggtggcactctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtggaaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacaggccgggagctccctgcagcctggaactgtgaggctgtcttgtttcgcttggcgtttcccatgcctggcagagggtaggcacttgggaaatatttgtagggtaaatgaat

SEQ ID NO: 5541 - DNA, 663 bp, Artificial Sequence
  Synthetic polypeptide
atggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacaggccgggagctccctgcagcctggaactgtgaggctgtcttgtttcgcttggcgtttcccatgcctggcagagggtaggcacttgggaaatatttgtagggtaaatgaat

SEQ ID NO: 5542 - DNA, 420 bp, Artificial Sequence
  Synthetic polypeptide
atggtaagtggaaataacagtgacagtgcccactgcataggcactggcctaagaggaaaagaaaccacattagtcacaccgcaggacagccctagaaagtgcccaatcaagggtagccctgaggaggcaacagcagatggtcacacaaatggacgaacaaaaaaattcatgtcttctcccctcactttccacagcgatgaccagagtggcagcgtggtgatctttggtggcattgactcttcttactacactggaagtctgaactgggtgcctgttaccgtcgagggttactggcagatcaccgtggacaggccgggagctccctgcagcctggaactgtgaggctgtcttgtttcgcttggcgtttcccatgcctggcagagggtaggcacttgggaaatatttgtagggtaaatgaat

SEQ ID NO: 5543 - DNA, 1070 bp, Artificial Sequence
  Synthetic polypeptide
atgcaaaaaatcaaatctctcatgacccgacagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagaaattgccatagccacttcggcctttagcaaccagcaccctgatcagtcagcagccatcaacattgagacaagaccctcgaccagaaaaaagatcgactcactgaaggcccagatgattattagcatttttttaaattttagcaattttttaaaattaaggtttatatgttgttttttaaagacataatgctattacacactttagactatagaacagtgtaaatgtaacttttatatacactgggaaataaaaaaatttgctttgtga

SEQ ID NO: 5544 - DNA, 503 bp, Artificial Sequence
  Synthetic polypeptide
atgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagaaattgccatagccacttcggcctttagcaaccagcaccctgatcagtcagcagccatcaacattgagacaagaccctcgaccagaaaaaagatcgactcactgaaggcccagatgattattagcatttttttaaattttagcaattttttaaaattaaggtttatatgttgttttttaaagacataatgctattacacactttagactatagaacagtgtaaatgtaacttttatatacactgggaaataaaaaaatttgctttgtga

SEQ ID NO: 5545 - DNA, 980 bp, Artificial Sequence
  Synthetic polypeptide
atgttaactttggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagaaattgccatagccacttcggcctttagcaaccagcaccctgatcagtcagcagccatcaacattgagacaagaccctcgaccagaaaaaagatcgactcactgaaggcccagatgattattagcatttttttaaattttagcaattttttaaaattaaggtttatatgttgttttttaaagacataatgctattacacactttagactatagaacagtgtaaatgtaacttttatatacactgggaaataaaaaaatttgctttgtga

SEQ ID NO: 5546 - DNA, 430 bp, Artificial Sequence
  Synthetic polypeptide
aacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagaaattgccatagccacttcggcctttagcaaccagcaccctgatcagtcagcagccatcaacattgagacaagaccctcgaccagaaaaaagatcgactcactgaaggcccagatgattattagcatttttttaaattttagcaattttttaaaattaaggtttatatgttgttttttaaagacataatgctattacacactttagactatagaacagtgtaaatgtaacttttatatacactgggaaataaaaaaatttgctttgtga

SEQ ID NO: 5547 - DNA, 882 bp, Artificial Sequence
  Synthetic polypeptide
atgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacaggccgggagctccctgcagcctggaactgtgaggctgtcttgtttcgcttggcgtttcccatgcctggcagagggtaggcacttgggaaatatttgtagggtaaatgaat

SEQ ID NO: 5548 - DNA, 420 bp, Artificial Sequence; identical to SEQ ID NO: 5542
  Synthetic polypeptide

SEQ ID NO: 5549 - DNA, 886 bp, Artificial Sequence
  Synthetic polypeptide
atgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgacaagagtggcagcgtggtgatctttggtggcattgactcttcttactacactggaagtctgaactgggtgcctgttaccgtcgagggttactggcagatcaccgtggacagctaggccgggagctccctgcagcctggaactgtgaggctgtcttgtttcgcttggcgtttcccatgcctggcagagggtaggcacttgggaaatatttgtagggtaaatgaat

SEQ ID NO: 5550 - DNA, 424 bp, Artificial Sequence
  Synthetic polypeptide
atggtaagtggaaacaacagtgacggtgcccactgcatgggccctggcctaagaggaaaagaaaccacattggtcacaccccaggacagccctggaaagtgcccaatcaacggtcgctctgaggaggcaacagcagatggtcacacaaatggacgaacaaaaaaattcatgtcttctcccctcactttccacagcgatgacaagagtggcagcgtggtgatctttggtggcattgactcttcttactacactggaagtctgaactgggtgcctgttaccgtcgagggttactggcagatcaccgtggacagctaggccgggagctccctgcagcctggaactgtgaggctgtcttgtttcgcttggcgtttcccatgcctggcagagggtaggcacttgggaaatatttgtagggtaaatgaat

SEQ ID NO: 5551 - DNA, 842 bp, Artificial Sequence
  Synthetic polypeptide
atgaagtggctgctgctgctgggtctggtggcactctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtggaaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgcttccaccactcccccgctgtatgaccttgggcaggtggcctcacctccctcaggctcagtgtcctcatggtaagtggaaataacagtgacagtgcccactgcataggcactggcctaagaggaaaagaaaccacattagtcacaccgcaggacagccctagaaagtgcccaatcaagggtagccct

SEQ ID NO: 5552 - DNA, 623 bp, Artificial Sequence
  Synthetic polypeptide
atggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgcttccaccactcccccgctgtatgaccttgggcaggtggcctcacctccctcaggctcagtgtcctcatggtaagtggaaataacagtgacagtgcccactgcataggcactggcctaagaggaaaagaaaccacattagtcacaccgcaggacagccctagaaagtgcccaatcaagggtagccct

SEQ ID NO: 5553 - DNA, 343 bp, Artificial Sequence; identical to SEQ ID NO: 4070
  Synthetic polypeptide

SEQ ID NO: 5554 - DNA, 391 bp, Artificial Sequence; identical to SEQ ID NO: 4273
  Synthetic polypeptide

SEQ ID NO: 5555 - DNA, 1620 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggagattgcagtgagcccagatcgcaccactgcactccagtctggcaacagagcaagactccatctcaaaaagaaaagaaaagaa

SEQ ID NO: 5556 - DNA, 1623 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggagattgcagtgagcccagatcgcaccactgcactccagtctggcaacagagcaagactccatctcaaaaagaaaagaaaagaa

SEQ ID NO: 5557 - DNA, 455 bp, Artificial Sequence
  Synthetic polypeptide
ccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggagattgcagtgagcccagatcgcaccactgcactccagtctggcaacagagcaagactccatctcaaaaagaaaagaaaagaa

SEQ ID NO: 5558 - DNA, 1198 bp, Artificial Sequence
  Synthetic polypeptide
atgcctcaaacccgatcccaggcacaggctacaatcagttttccaaaaaggaagctgtctcgggcattgaacaaagctaaaaactccagtgatgccaaactagaaccaacaaatgtccaaaccgtaacctgttctcctcgtgtaaaagccctgcctctcagccccaggaaacgtctgggcgatgacaacctatgcaacactccccatttacctccttgttctccaccaaagcaaggcaagaaagagaatggtccccctcactcacatacacttaagggacgaagattggtatttgacaatcagctgacaattaagtctcctagcaaaagagaactagccaaagttcaccaaaacaaaatactttcttcagttagaaaaagtcaagagatcacaacaaattctgagcagagatgtccactgaagaaagaatctgcatgtgtgagactattcaagcaagaaggcacttgctaccagcaagcaaagctggtcctgaacacagctgtcccagatcggctgcctgccagggaaagggagatggatgtcatcaggaatttcttgagggaacacatctgtgggaaaaaagctggaagcctttacctttctggtgctcctggaactggaaaaactgcctgcttaagccggattctgcaagacctcaagaaggaactgaaaggctttaaaactatcatgctgaattgcatgtccttgaggactgcccaggctgtattcccagctattgctcaggagatttgtcaggaagaggtatccaggccagctgggaaggacatgatgaggaaattggaaaaacatatgactgcagagaagggccccatgattgtgttggtattggacgagatggatcaactggacagcaaaggccaggatgtattgtacacgctatttgaatggccatggctaagcaattctcacttggtgctgattggtattgctaataccctggatctcacagatagaattctacctaggcttcaagctagagaaaaatgtaagccacagctgttgaacttcccaccttataccagaaatcagatagtcactattttgcaagatcgacttaatcaggtatctagagatcaggttctggacaatgctgcagttcaattctgtgcccgcaaagtctctgctgtttcaggagatgttcgcaaagcactggatgtttgcagaaattttttttata

SEQ ID NO: 5559 - DNA, 1893 bp, Artificial Sequence
  Synthetic polypeptide
atggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctgttgttgccacctcctccctttcatggttccatcagccgccttcatcaaatcaaacagtctccctctgatgccgagcggaagctggactgtactgctgccatctcggctcactgcaacctccctgcctgattctcctgcctcagcctgccgagtgcctgcgattgcaggcgcgcgcagccacacctgactggttttcgtatttttttggtggagacggggtttcgctgtgttggccgggctggtctccagctcctaaccgcaagtgatctgccagcctcggcctcccgaggtgccgggattgcagacggagtctggttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcatctctgcctggccgcccatcgtctgggaggtgaggagcccctctgcctggctgcccagtctggaaagtgaggagcgtctctgcccggccgccatcccatctaggaagtgaggagcgcctcttcccggccgccatcccatctaggaagtgaggagcgtctctgccccgctgccccgtctgggatgtgaggagcgcctctgcccggccgcgaccccgtctgggaggtgaggagcatctctgcccggccgccccgtctgagaagtgaggagaccctccgcctggcaaccgccccgtctgagaagtgaggagcccctccgcccagcagccgccccgtctgagaagtgaggagcccctccgcccggcagccacaccgtctgggaagtgaggagcgtctctgcccggcagccaccccgtccgggagggaggtgggggtcagcccccgccaggccagccgccccatccgggaggtgaggggtgcctctgcccagccgcccctactgggaagtgaggagcccctctgcccggccatccgccccatccaggagggaggtgggggggtcagtcccccgcccggccagccgccccgtccgggagggaggtgggggggtcagccccccgcccggccagccgcctcgtccgggaggtgaggggcgcctctgcccggccgcccctactgggaagtgaggagcccctctgcccggccagccgccccgtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaattcttctgccttgggatcctgtagatctgtgaccttacccccaaccctgtgctctctgaaacatgtgctgtgtccactcagggttaaatggattaagggcggtgcaagatgtgctttgttaaacagatgcttgaaggcagcgtgctcgttaagagtcatcaccactccctattctcaagtacccagggacacaaacactgcggaaggccgcagggtcctctgcctaggaaaaccagagacctttgttcacttgtttatctgctgaccttccctccactattgtcctgagaccctgccaaatccccctctgcgagaaacacgcaagaatgatcaataaaaaaaaaaacaaaaaa

SEQ ID NO: 5560 - DNA, 1142 bp, Artificial Sequence; identical to SEQ ID NO: 2159
  Synthetic polypeptide

SEQ ID NO: 5561 - DNA, 400 bp, Artificial Sequence; identical to SEQ ID NO: 4369
  Synthetic polypeptide

SEQ ID NO: 5562 - DNA, 279 bp, Artificial Sequence
  Synthetic polypeptide
atgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcggaatttcatgtcttctgccagtgtctgtgaaacagtaacaggctaacttattagcttgtaagtggaatccaatcaaatcccagacctgaca

SEQ ID NO: 5563 - DNA, 865 bp, Artificial Sequence; identical to SEQ ID NO: 366
  Synthetic polypeptide

SEQ ID NO: 5564 - DNA, 1385 bp, Artificial Sequence
  Synthetic polypeptide
atggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttcatttgaaaggaaggttct

SEQ ID NO: 5565 - DNA, 1193 bp, Artificial Sequence
  Synthetic polypeptide
atggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttcatttgaaaggaaggttct

SEQ ID NO: 5566 - DNA, 641 bp, Artificial Sequence
  Synthetic polypeptide
agaagcctggatacaattactctatcaggagatgaaagggactttgggagactgaatgtgaaattgttttataattcttcagtagaacagatctggatcacagttttacaggctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttcatttgaaaggaaggttct

SEQ ID NO: 5567 - DNA, 350 bp, Artificial Sequence; identical to SEQ ID NO: 3337
  Synthetic polypeptide

SEQ ID NO: 5568 - DNA, 98 bp, Artificial Sequence
  Synthetic polypeptide
atggatgtgaggttctaccccgcggcggccggggaccctgccagcctggacttcgcgcagtgcctggggtactacggctacagcaagttctcttccag

SEQ ID NO: 5569 - DNA, 118 bp, Artificial Sequence; identical to SEQ ID NO: 162
  Synthetic polypeptide

SEQ ID NO: 5570 - DNA, 212 bp, Artificial Sequence
  Synthetic polypeptide
atgaatcctgtttatagtcctggatcttctggggttccctatgcaaatgccaaaggaattggttatccagctcttcggaaggctgaggcaggagaatcgcttgaacctgggaggcagaggttgcagtgagccaagatcatgccattgcactccagcctgggcgatgaaagtgaaactctgtctcaaaagacgacaacgataaaaaaaacaaa

SEQ ID NO: 5571 - DNA, 52 bp, Artificial Sequence; identical to SEQ ID NO: 4331
  Synthetic polypeptide

SEQ ID NO: 5572 - DNA, 237 bp, Artificial Sequence; identical to SEQ ID NO: 4230
  Synthetic polypeptide

SEQ ID NO: 5573 - DNA, 660 bp, Artificial Sequence; identical to SEQ ID NO: 4231
  Synthetic polypeptide

SEQ ID NO: 5574 - DNA, 44 bp, Artificial Sequence
  Synthetic polypeptide
atgttgcacttaactgatattcagttactccagtttattaactg

SEQ ID NO: 5575 - DNA, 353 bp, Artificial Sequence
  Synthetic polypeptide
atggcgacggcggcctacgagcagctgaagctgcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctggtggcaggtaattatcttatagtcattaccaaaaagataaaagtaggtgaatttttcagtcatgtagtctggaaagcaacagattttgatgtcctttcttataagaagacaatgttgcacttaactgatattcagttactccagtttattaactg

SEQ ID NO: 5576 - DNA, 393 bp, Artificial Sequence; identical to SEQ ID NO: 1400
  Synthetic polypeptide

SEQ ID NO: 5577 - DNA, 272 bp, Artificial Sequence; identical to SEQ ID NO: 1401
  Synthetic polypeptide

SEQ ID NO: 5578 - DNA, 2095 bp, Artificial Sequence; identical to SEQ ID NO: 2095
  Synthetic polypeptide

SEQ ID NO: 5579 - DNA, 82 bp, Artificial Sequence
  Synthetic polypeptide
atggcggccggcgaaaggagctggtgcctgtgcaagttgttgagtttcgagtatgtctttatcagcagcgtgaaaatgaact

SEQ ID NO: 5580 - DNA, 1838 bp, Artificial Sequence; identical to SEQ ID NO: 2152
  Synthetic polypeptide

SEQ ID NO: 5581 - DNA, 842 bp, Artificial Sequence; identical to SEQ ID NO: 5551
  Synthetic polypeptide

SEQ ID NO: 5582 - DNA, 623 bp, Artificial Sequence; identical to SEQ ID NO: 5552
  Synthetic polypeptide

SEQ ID NO: 5583 - DNA, 1421 bp, Artificial Sequence
  Synthetic polypeptide
atggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtctgcagcttcactcctgaagccagcgagaccacgaacccaccgggaggaacgaacaactccagatgcgccgccttaagagctgtaacactcaccgcgaaggtccgtggcctcactcctgagcccccaagaccacgaacccaccagaaggaagaaactccaaacacatccgaacatcagaaggaacaaactctggacacgctgactttaagaactgtaacactcaccgcgaaggtctgcggcttcattcttgaagtcagtgagaccaagaacccaccaattccggacaca

SEQ ID NO: 5584 - DNA, 1430 bp, Artificial Sequence
  Synthetic polypeptide
atggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaaggtgaaagagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtctgcagcttcactcctgaagccagcgagaccacgaacccaccgggaggaacgaacaactccagatgcgccgccttaagagctgtaacactcaccgcgaaggtccgtggcctcactcctgagcccccaagaccacgaacccaccagaaggaagaaactccaaacacatccgaacatcagaaggaacaaactctggacacgctgactttaagaactgtaacactcaccgcgaaggtctgcggcttcattcttgaagtcagtgagaccaagaacccaccaattccggacaca

SEQ ID NO: 5585 - DNA, 867 bp, Artificial Sequence
  Synthetic polypeptide
gggaagcccagtggaggacaatgagaaggatctggtgaaactggctaaacgcctcaagaaggagaaagtaaatgttgacattatcaattttggggaagaggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtctgcagcttcactcctgaagccagcgagaccacgaacccaccgggaggaacgaacaactccagatgcgccgccttaagagctgtaacactcaccgcgaaggtccgtggcctcactcctgagcccccaagaccacgaacccaccagaaggaagaaactccaaacacatccgaacatcagaaggaacaaactctggacacgctgactttaagaactgtaacactcaccgcgaaggtctgcggcttcattcttgaagtcagtgagaccaagaacccaccaattccggacaca

SEQ ID NO: 5586 - DNA, 541 bp, Artificial Sequence
  Synthetic polypeptide
acattgatgccagctcagctatggacacatctgagccagccaagagctcaattaacagagttctcagcaggcccctctatttggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtctgcagcttcactcctgaagccagcgagaccacgaacccaccgggaggaacgaacaactccagatgcgccgccttaagagctgtaacactcaccgcgaaggtccgtggcctcactcctgagcccccaagaccacgaacccaccagaaggaagaaactccaaacacatccgaacatcagaaggaacaaactctggacacgctgactttaagaactgtaacactcaccgcgaaggtctgcggcttcattcttgaagtcagtgagaccaagaacccaccaattccggacaca

SEQ ID NO: 5587 - DNA, 1685 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtggagattgcagtgagcccagatcgcaccactgcactccagtctggcaacagagcaagactccatctcaaaaagaaaagaaaagaa

SEQ ID NO: 5588 - DNA, 1688 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtggagattgcagtgagcccagatcgcaccactgcactccagtctggcaacagagcaagactccatctcaaaaagaaaagaaaagaa

SEQ ID NO: 5589 - DNA, 980 bp, Artificial Sequence; identical to SEQ ID NO: 139
  Synthetic polypeptide

SEQ ID NO: 5590 - DNA, 1256 bp, Artificial Sequence; identical to SEQ ID NO: 140
  Synthetic polypeptide

SEQ ID NO: 5591 - DNA, 1277 bp, Artificial Sequence; identical to SEQ ID NO: 142
  Synthetic polypeptide

SEQ ID NO: 5592 - DNA, 1846 bp, Artificial Sequence
  Synthetic polypeptide
atggcggcggccgcggcggcgctctcgggcgcgggcacgccacccgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaaggtgggccgggggggaaaggaggagaggggagaccacagggaggtcaaaggtaggcggaggggaaaggaggagaggggagaccacagggaggtgaaaggtgggcgggggggaaaggaggagaggggagaccacagggaggtcaaaggtgggccggggggggaaaggaggagaggggagaccacagggaggtcaaaggtgggccgggggggaaaggaggagaggggagaccacagggaggtcaaaggtaggcggaggggaaaggaggagagg

SEQ ID NO: 5593 - DNA, 341 bp, Artificial Sequence
  Synthetic polypeptide
caccccggcagccgtgctggcccctcctaaggcagaggcccaggagaatggagaccacagggaagtcaaaggtgggccgggggggaaaggaggagaggggagaccacagggaggtcaaaggtaggcggaggggaaaggaggagaggggagaccacagggaggtgaaaggtgggcgggggggaaaggaggagaggggagaccacagggaggtcaaaggtgggccggggggggaaaggaggagaggggagaccacagggaggtcaaaggtgggccgggggggaaaggaggagaggggagaccacagggaggtcaaaggtaggcggaggggaaaggaggagagg

SEQ ID NO: 5594 - DNA, 1093 bp, Artificial Sequence; identical to SEQ ID NO: 2131
  Synthetic polypeptide

SEQ ID NO: 5595 - DNA, 1234 bp, Artificial Sequence; identical to SEQ ID NO: 2132
  Synthetic polypeptide

SEQ ID NO: 5596 - DNA, 443 bp, Artificial Sequence
  Synthetic polypeptide
atggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggcaaaaaggccctcaccagatgctggcgccttgattttagacttcccagcctccagaactgtgagcgaataaatttctgttcatcataaattacctactcaggttttctgtcaacagcaacacaaaatggactaaga

SEQ ID NO: 5597 - DNA, 842 bp, Artificial Sequence
  Synthetic polypeptide
atgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgcttccaccactcccccgctgtatgaccttgggcaggtggcctcacctccctcaggctcagtgtcctcatggtaagtggaaataacagtgacagtgcccactgcataggcactggcctaagaggaaaagaaaccacattagtcacaccgcaggacagccctagaaagtgcccaatcaagggtagccct

SEQ ID NO: 5598 - DNA, 1257 bp, Artificial Sequence; identical to SEQ ID NO: 4461
  Synthetic polypeptide

SEQ ID NO: 5599 - DNA, 1173 bp, Artificial Sequence; identical to SEQ ID NO: 4462
  Synthetic polypeptide

SEQ ID NO: 5600 - DNA, 1125 bp, Artificial Sequence; identical to SEQ ID NO: 4463
  Synthetic polypeptide

SEQ ID NO: 5601 - DNA, 199 bp, Artificial Sequence; identical to SEQ ID NO: 2168
  Synthetic polypeptide

SEQ ID NO: 5602 - DNA, 2106 bp, Artificial Sequence
  Synthetic polypeptide
atggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggacagtatacagacaacccaaagagtgagaaaaaatcttcatgatctatatatccgacaaaagactaatatccagactctacaaagaactcacattagcaagaaacaaacagtcccatcaaacaatgggctaaagacatgaatagacaattcttgaaagaagatatacaaatggccaacaaacatatgaaaaaatgcccaacatcactaatgatcagggaaatgcaaatcgaaaccacaatgttataccaccttactcctgcaagattggatataatcaaaaaatcaaaaaacagtagatgctggtgtggatgtggtgaacagggaacacttctacactgctggtgggagtgcaaactagcacagccactatggaaaacagtgtggagattccttaaagaactaaaagaactaccatttgattcagcaatcccactgctgggtatctacctggaggacaagaagtcattatacgagaaagatatttgcacacacgtttatagcagcacaatttgcaattgcaaaaatatggaaccaacccaaatgcccatcaatcaatgagtagataaagaaatcgtgg

SEQ ID NO: 5603 - DNA, 2169 bp, Artificial Sequence
  Synthetic polypeptide
atggggccgccgctcccgctgctgctgctgctactgctgctgctgccgccacgcgtcctgcctgccgccccttcgtccgtcccccgcggccggcagctcccggggcgtctggatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggacagtatacagacaacccaaagagtgagaaaaaatcttcatgatctatatatccgacaaaagactaatatccagactctacaaagaactcacattagcaagaaacaaacagtcccatcaaacaatgggctaaagacatgaatagacaattcttgaaagaagatatacaaatggccaacaaacatatgaaaaaatgcccaacatcactaatgatcagggaaatgcaaatcgaaaccacaatgttataccaccttactcctgcaagattggatataatcaaaaaatcaaaaaacagtagatgctggtgtggatgtggtgaacagggaacacttctacactgctggtgggagtgcaaactagcacagccactatggaaaacagtgtggagattccttaaagaactaaaagaactaccatttgattcagcaatcccactgctgggtatctacctggaggacaagaagtcattatacgagaaagatatttgcacacacgtttatagcagcacaatttgcaattgcaaaaatatggaaccaacccaaatgcccatcaatcaatgagtagataaagaaatcgtgg

SEQ ID NO: 5604 - DNA, 2220 bp, Artificial Sequence
  Synthetic polypeptide
atggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggacagtatacagacaacccaaagagtgagaaaaaatcttcatgatctatatatccgacaaaagactaatatccagactctacaaagaactcacattagcaagaaacaaacagtcccatcaaacaatgggctaaagacatgaatagacaattcttgaaagaagatatacaaatggccaacaaacatatgaaaaaatgcccaacatcactaatgatcagggaaatgcaaatcgaaaccacaatgttataccaccttactcctgcaagattggatataatcaaaaaatcaaaaaacagtagatgctggtgtggatgtggtgaacagggaacacttctacactgctggtgggagtgcaaactagcacagccactatggaaaacagtgtggagattccttaaagaactaaaagaactaccatttgattcagcaatcccactgctgggtatctacctggaggacaagaagtcattatacgagaaagatatttgcacacacgtttatagcagcacaatttgcaattgcaaaaatatggaaccaacccaaatgcccatcaatcaatgagtagataaagaaatcgtgg

SEQ ID NO: 5605 - DNA, 2289 bp, Artificial Sequence
  Synthetic polypeptide
atggctgtggaatctgaatattcactgctgagaaccgaagccagctttcctactatgaagatgttctgtgtgagccacaccttgcccagggtggaagtgatgtttgtttcaggtccacagacgagggagaggacggagccagtggaccctcggtggcagtgtctggtgcagatgtgggcaggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggacagtatacagacaacccaaagagtgagaaaaaatcttcatgatctatatatccgacaaaagactaatatccagactctacaaagaactcacattagcaagaaacaaacagtcccatcaaacaatgggctaaagacatgaatagacaattcttgaaagaagatatacaaatggccaacaaacatatgaaaaaatgcccaacatcactaatgatcagggaaatgcaaatcgaaaccacaatgttataccaccttactcctgcaagattggatataatcaaaaaatcaaaaaacagtagatgctggtgtggatgtggtgaacagggaacacttctacactgctggtgggagtgcaaactagcacagccactatggaaaacagtgtggagattccttaaagaactaaaagaactaccatttgattcagcaatcccactgctgggtatctacctggaggacaagaagtcattatacgagaaagatatttgcacacacgtttatagcagcacaatttgcaattgcaaaaatatggaaccaacccaaatgcccatcaatcaatgagtagataaagaaatcgtgg

SEQ ID NO: 5606 - DNA, 5277 bp, Artificial Sequence
  Synthetic polypeptide
atggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgcaaggcccatcttttgcctacggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaagaacgctccagcccaggacttcgaggctgcaatgagctataattgcatcattgcactccagcctgggcaacagagaccctgtctca

SEQ ID NO: 5607 - DNA, 5256 bp, Artificial Sequence
  Synthetic polypeptide
atggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaagaacgctccagcccaggacttcgaggctgcaatgagctataattgcatcattgcactccagcctgggcaacagagaccctgtctca

SEQ ID NO: 5608 - DNA, 261 bp, Artificial Sequence
  Synthetic polypeptide
atggtggtgggcgcgttccctatggcgaagctgctatacttgggcatccggcaggtcagcaagccgcttgccaaccgtattaaggaggccgcccgccgaagcgagttcttcaagacctatatctgcctcccgccggctcaacgaactgactgagcgcaagaagacagctccgactccctgtgatttcatctctgaccaatcagcactcctggctcactggcttcccctcacccatcaagttatccttaaaaactctgctcc

SEQ ID NO: 5609 - DNA, 2749 bp, Artificial Sequence
  Synthetic polypeptide
atgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgaacactcatgccctttgcctcttacagccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggaggttgcattcaactgagatcataccacttcattccagcctgggtgacagagcaagactctgtctcaaaaaaaaaaaaaaggaaaa

SEQ ID NO: 5610 - DNA, 2722 bp, Artificial Sequence
  Synthetic polypeptide
atgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggaggttgcattcaactgagatcataccacttcattccagcctgggtgacagagcaagactctgtctcaaaaaaaaaaaaaaggaaaa

SEQ ID NO: 5611 - DNA, 216 bp, Artificial Sequence
  Synthetic polypeptide
atgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaagggtcagcctgtgggggaa

SEQ ID NO: 5612 - DNA, 144 bp, Artificial Sequence
  Synthetic polypeptide
atgttggactgcggactggacatgacttctaccctcaatttccttcctttgccacttgttcaaagtcccaggctgtccaatcttcctggctggtccctgaaggatggaaatgctttcttggacaagggtcagcctgtgggggaa

SEQ ID NO: 5613 - DNA, 88 bp, Artificial Sequence
  Synthetic polypeptide
atgaaactgtcccaggctgtccaatcttcctggctggtccctgaaggatggaaatgctttcttggacaagggtcagcctgtgggggaa

SEQ ID NO: 5614 - DNA, 190 bp, Artificial Sequence
  Synthetic polypeptide
cccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaagggtcagcctgtgggggaa

SEQ ID NO: 5615 - DNA, 2437 bp, Artificial Sequence; identical to SEQ ID NO: 1794
  Synthetic polypeptide

SEQ ID NO: 5616 - DNA, 1224 bp, Artificial Sequence; identical to SEQ ID NO: 1795
  Synthetic polypeptide

SEQ ID NO: 5617 - DNA, 95 bp, Artificial Sequence; identical to SEQ ID NO: 4289
  Synthetic polypeptide

SEQ ID NO: 5618 - DNA, 1324 bp, Artificial Sequence; identical to SEQ ID NO: 326
  Synthetic polypeptide

SEQ ID NO: 5619 - DNA, 721 bp, Artificial Sequence; identical to SEQ ID NO: 414
  Synthetic polypeptide

SEQ ID NO: 5620 - DNA, 5763 bp, Artificial Sequence
  Synthetic polypeptide
atgtgtaaaatggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaaattggcctgcttggacctgtaacaccagtgccagtgtacactgccttggggcccaaggaaatgcatgctcaacccactgctgctatcatggggcctgaagactgacttacctgccaccccaggccctagcaaaacgttaccacagcctccactaataactgcaccataagctactgaggaaatcacagataactggtgctgtgtacagctgaagaaatcttacagagactacactactgcatacatctagaatcatagctaaagtgccctacccaaccaacaccatagatacatgttcaaaacaatgccctcccctgttaaagtaaattcaaaaaattgaaggcagtgactgacaccagatgcccaagtagcaacataaggatgcaggaaacatcaaaaagcaaggaaatatgacatctccaggggaacacaataattcttcagcaatgattccgatcaaaaagaaattcacgaaatcctgaacaaataattcacattcttgattgtgaagaagctcagtgagataccagggaattatgaaaaataatacatagaaatcagaaaaacagtgcaggatatgaatgaaaaatttgccaaagagatagttatcataaaaaagaaccatacagaaatcctgaaactgaagaattcattgaatgaaataaaaaatgttagattcaacaatagtctagattaagcagaagaaggaatctgacaactcaaagacagaagacaggtctttcaaaataacctaatcagacagaaataatgttaaaagaataaaaaagaataattgaagccttcgagacatatgggatactataaagccaccacatatttgaatcatttgggtcccagaagacagagaacaaaaggattggaaaactcatctatttttttgttattaaataatagatgaaaacttcccaaatctatcaaatgatttagatatccagaaacaggaggctccaagatccgcaaacatatacaatgcaagaaagtcttctccttggcacattatagtcaaactatctaaagtcaaagacagaattctgaaaaaggcaagagaaaagtgcctagtcagttgtaaagaaaaccttatcaggctaatagtgaatttctcagcagaaaccttacaagccaggaaagaatgatacattcaaagtactgaatgaaaaaaatgctatccaagggatactatatctagcaaaaatattctttgtaactgaaggagaaataaagtcttccccagaaattgcttaagggagtcctaatcctgggagcaaaatgactacatttaccatcatgaaaacttatgaatgtgtaaaacctgctaataaagcaatcacacaaaggaataagggaaagtaattaaatggtacctgtacggaaaaccaccaaaccaaaattagaaaaaataagtgaaaaagaaaggaatgaagagtatataaaaccagaaaacaataacaatataataggaacaaaacctcacatgttaataataatcttgaatgtggaaggattgaattttccacttagaagctacagcctggcagaatggattaaaaattaagatccagctatatattacctgcaagaaacacactttacctataatggcacatgtagactaaaaataaaggaatggaaaaaattactccacacgaacagaaaccaaaagtgagtaggagtagctatacttatgtcagataaaacagactttaagtcaaacacagtaaaaaaaaaaaaaaaaaaaaaaaaaagacaaggtcattatgcaatgacaaaggaatcaattcagcaacagaatattatggctctaaatatatatgtgtccaacactggagcaacaagattcataggataaatattactagatttaaggagagagactacaatacaataatagtggggaactccaaccccattctcagcatgagacaaatcatttagacagaaagttaacaaacatttataaacttttatttaaactggattttagactacctggactcaacagatatttacagaacattttatccaaaaactacagaatataaagtcttctcatcagcacatggaatattctccagaatagactgttaggccacaaaataggtaacaacaattttttaaaacgcaagatcatatcaactatgtcctcagaacacaatggaataaaactagaaatatcaagaggatctttggaaactatacggatgtatggaattaaacaacatgttcctgaatgacgattagatcaattaagaaattaagaaggaagttaaaaaatttcttgaaacgaatgaaagtggaaacacaacataccaaaacctgtgggatacagcaaaagcagtactaacatgaagtttatagcaataaatgcccacatcaaaacagtagagtttaaataaacaatctaatgatgcacctcaagaaactagaaaagcaagaacaaaacaaatccaagattaggagaaagaaagaaataatgtagatcagggcagagataagcaaaatagagactaaagtaacagttcaaaggatcagttaaacgaaaagttgattctttgaaaagacacaaaattgataaatcactagcttgactaaccaagaaaaggagagatgacccacataaatcagaaataaaaaagaaattacatctgataccacagaaatacaaaggttcatcagagactatcatgaacagctacacactaacagactggaaaatctagaggaaatggataatttcctggacacctaccatctaccaagcttgaatctggaaaaaacagaaagcctgaacaaaccaataaccagtaacaaagtcatatcagtaataaaaagtctctcagcaaagaaagggctaggagcagattgattcttggccgaattctaccatatgtataaagaagaactgatactaatcctcttgaaactattccaaaaaattgaagagaaaggaattctccctaactcattctatgagggcagcatcacccttataccaaaaccagacaaggacacacaaaaaaagaaaagtacaggtcattattcttgatgaatatggattcaaaaatcctcgacagaatactggcaaactgattcctactgcacattgaaaagataatacaccacaatcaagtgggctttataccagggctacaaggatggttcaacatatgcaaattaacaaatgtgatacatcacgtaagcagaatgaatgataaaaaacatacgatcatctcaatagttgtagaaaaagcatttgataaaattcagcatcccttcatgataaaaaactctcagcaaatatggcatagaagaaacatacctcaaaatcataaaggacatatatggcaaactcacagctaacatcatactgaatggggaaaagttgaaagtctttgctttaggaacagaaacaataccaggatgcccattttcaccactcctattctacatggcactggaaatcctagcaaatcacacaagattaaaaaataaaatgcatttaaattggtagaaaggaagtcagactgtttacctttgagatgacgtgatcttattagaaaaaaacaagactaccacaaaaaactcttagaactgataaacaaattcagccaagttgcagaatacaaaatgaacatgtaaaaatcagtagtgttcctatacaagtataatgaaatagccaccaaagatatcaagaaggcaattctatttacactagctattaaaaaaacataggaataaatttaaccaaggaggtaaagatttcgacaaagcaaactacaaaagatggatgaacgaaatagaagacaaacaaatgaaaagatatcccatgctcatgaatcaaaagaatttatagcatttgtcaattttggcttttgttgccattgcttttggtgttttagacatgaagtccttgcccatgcgtatgtcctgaatggtattgcctaggttttcttctagggtttttatggctttaggtctaacatttaagtctttaatccatcttgaattaatttttgtataaggtgtaaggaagggatccagtttcagctttctacatacagctagccagttttcccagcaccatttattaaatagggaatcctttccccattgcttatttttgtcaggtttgtcaaagatcagatagttgtagatatgtggcattatttctgagggctctgttctgttccattggtctatatctctgttttggtaccagtaccatgctgttttggttactgtagccttgtagtacagtttgaagtcaggtagcgtgatgcctccagcattattcttttggcttaggattggcttggcaatgtgggctctcttttggttccatatgaactttaaagtagtttttttccaattctgtgaagaaagtcattggtagcttgatggggatggcattgaatctataaattaccttgggcagtatggccattttcacgatattgattcttcctacccatgagcatggaaagttcttccatttgtatgggatctaattaatctaaagagcttctgcacagcaaaagaaactaccatcagagtgaacaggcaacctacagaatgggagaaaatttttgcaatctacgcatctgacaaagggctaatatccagaatctacaaagaactcagacaaatttagaagaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtgaactagttcaaccattgtggaagtcagtgtggcgatccctcagggatctagaattagaaataccatttgacccagccatcccattactgggtatatacccaaagaattataaatcatgctgctataaagacacatgcacacgtatgtttattgcagcactattcacaatagcaaagacttggaaccaacccaaatgtccaacaatgatagactggattaagaaaatgtggcacatatacaccatggaaaactatgtagccataaaaaatgatgagttcatgtcctttgtaggaacatggatgaagatggaaaccatcattctcagcaaactttcgcaaggacaaaaaccaaacatcgcgtgttctcactcataggtgggaattgaacaatgagaacacttggacacaggaagaggaacatcacacaccagggcctgttgtggggagggatagcattaggaggtatgcctaatgttaaatgacgagttaacgggtgcagcacaccaacatggcacatgtatacatatgtaacaaacctgcacattgtgcacatgtaccctaaaacttaaagtataatttaaaaaa

SEQ ID NO: 5621 - DNA, 5853 bp, Artificial Sequence
  Synthetic polypeptide
atggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaaattggcctgcttggacctgtaacaccagtgccagtgtacactgccttggggcccaaggaaatgcatgctcaacccactgctgctatcatggggcctgaagactgacttacctgccaccccaggccctagcaaaacgttaccacagcctccactaataactgcaccataagctactgaggaaatcacagataactggtgctgtgtacagctgaagaaatcttacagagactacactactgcatacatctagaatcatagctaaagtgccctacccaaccaacaccatagatacatgttcaaaacaatgccctcccctgttaaagtaaattcaaaaaattgaaggcagtgactgacaccagatgcccaagtagcaacataaggatgcaggaaacatcaaaaagcaaggaaatatgacatctccaggggaacacaataattcttcagcaatgattccgatcaaaaagaaattcacgaaatcctgaacaaataattcacattcttgattgtgaagaagctcagtgagataccagggaattatgaaaaataatacatagaaatcagaaaaacagtgcaggatatgaatgaaaaatttgccaaagagatagttatcataaaaaagaaccatacagaaatcctgaaactgaagaattcattgaatgaaataaaaaatgttagattcaacaatagtctagattaagcagaagaaggaatctgacaactcaaagacagaagacaggtctttcaaaataacctaatcagacagaaataatgttaaaagaataaaaaagaataattgaagccttcgagacatatgggatactataaagccaccacatatttgaatcatttgggtcccagaagacagagaacaaaaggattggaaaactcatctatttttttgttattaaataatagatgaaaacttcccaaatctatcaaatgatttagatatccagaaacaggaggctccaagatccgcaaacatatacaatgcaagaaagtcttctccttggcacattatagtcaaactatctaaagtcaaagacagaattctgaaaaaggcaagagaaaagtgcctagtcagttgtaaagaaaaccttatcaggctaatagtgaatttctcagcagaaaccttacaagccaggaaagaatgatacattcaaagtactgaatgaaaaaaatgctatccaagggatactatatctagcaaaaatattctttgtaactgaaggagaaataaagtcttccccagaaattgcttaagggagtcctaatcctgggagcaaaatgactacatttaccatcatgaaaacttatgaatgtgtaaaacctgctaataaagcaatcacacaaaggaataagggaaagtaattaaatggtacctgtacggaaaaccaccaaaccaaaattagaaaaaataagtgaaaaagaaaggaatgaagagtatataaaaccagaaaacaataacaatataataggaacaaaacctcacatgttaataataatcttgaatgtggaaggattgaattttccacttagaagctacagcctggcagaatggattaaaaattaagatccagctatatattacctgcaagaaacacactttacctataatggcacatgtagactaaaaataaaggaatggaaaaaattactccacacgaacagaaaccaaaagtgagtaggagtagctatacttatgtcagataaaacagactttaagtcaaacacagtaaaaaaaaaaaaaaaaaaaaaaaaaagacaaggtcattatgcaatgacaaaggaatcaattcagcaacagaatattatggctctaaatatatatgtgtccaacactggagcaacaagattcataggataaatattactagatttaaggagagagactacaatacaataatagtggggaactccaaccccattctcagcatgagacaaatcatttagacagaaagttaacaaacatttataaacttttatttaaactggattttagactacctggactcaacagatatttacagaacattttatccaaaaactacagaatataaagtcttctcatcagcacatggaatattctccagaatagactgttaggccacaaaataggtaacaacaattttttaaaacgcaagatcatatcaactatgtcctcagaacacaatggaataaaactagaaatatcaagaggatctttggaaactatacggatgtatggaattaaacaacatgttcctgaatgacgattagatcaattaagaaattaagaaggaagttaaaaaatttcttgaaacgaatgaaagtggaaacacaacataccaaaacctgtgggatacagcaaaagcagtactaacatgaagtttatagcaataaatgcccacatcaaaacagtagagtttaaataaacaatctaatgatgcacctcaagaaactagaaaagcaagaacaaaacaaatccaagattaggagaaagaaagaaataatgtagatcagggcagagataagcaaaatagagactaaagtaacagttcaaaggatcagttaaacgaaaagttgattctttgaaaagacacaaaattgataaatcactagcttgactaaccaagaaaaggagagatgacccacataaatcagaaataaaaaagaaattacatctgataccacagaaatacaaaggttcatcagagactatcatgaacagctacacactaacagactggaaaatctagaggaaatggataatttcctggacacctaccatctaccaagcttgaatctggaaaaaacagaaagcctgaacaaaccaataaccagtaacaaagtcatatcagtaataaaaagtctctcagcaaagaaagggctaggagcagattgattcttggccgaattctaccatatgtataaagaagaactgatactaatcctcttgaaactattccaaaaaattgaagagaaaggaattctccctaactcattctatgagggcagcatcacccttataccaaaaccagacaaggacacacaaaaaaagaaaagtacaggtcattattcttgatgaatatggattcaaaaatcctcgacagaatactggcaaactgattcctactgcacattgaaaagataatacaccacaatcaagtgggctttataccagggctacaaggatggttcaacatatgcaaattaacaaatgtgatacatcacgtaagcagaatgaatgataaaaaacatacgatcatctcaatagttgtagaaaaagcatttgataaaattcagcatcccttcatgataaaaaactctcagcaaatatggcatagaagaaacatacctcaaaatcataaaggacatatatggcaaactcacagctaacatcatactgaatggggaaaagttgaaagtctttgctttaggaacagaaacaataccaggatgcccattttcaccactcctattctacatggcactggaaatcctagcaaatcacacaagattaaaaaataaaatgcatttaaattggtagaaaggaagtcagactgtttacctttgagatgacgtgatcttattagaaaaaaacaagactaccacaaaaaactcttagaactgataaacaaattcagccaagttgcagaatacaaaatgaacatgtaaaaatcagtagtgttcctatacaagtataatgaaatagccaccaaagatatcaagaaggcaattctatttacactagctattaaaaaaacataggaataaatttaaccaaggaggtaaagatttcgacaaagcaaactacaaaagatggatgaacgaaatagaagacaaacaaatgaaaagatatcccatgctcatgaatcaaaagaatttatagcatttgtcaattttggcttttgttgccattgcttttggtgttttagacatgaagtccttgcccatgcgtatgtcctgaatggtattgcctaggttttcttctagggtttttatggctttaggtctaacatttaagtctttaatccatcttgaattaatttttgtataaggtgtaaggaagggatccagtttcagctttctacatacagctagccagttttcccagcaccatttattaaatagggaatcctttccccattgcttatttttgtcaggtttgtcaaagatcagatagttgtagatatgtggcattatttctgagggctctgttctgttccattggtctatatctctgttttggtaccagtaccatgctgttttggttactgtagccttgtagtacagtttgaagtcaggtagcgtgatgcctccagcattattcttttggcttaggattggcttggcaatgtgggctctcttttggttccatatgaactttaaagtagtttttttccaattctgtgaagaaagtcattggtagcttgatggggatggcattgaatctataaattaccttgggcagtatggccattttcacgatattgattcttcctacccatgagcatggaaagttcttccatttgtatgggatctaattaatctaaagagcttctgcacagcaaaagaaactaccatcagagtgaacaggcaacctacagaatgggagaaaatttttgcaatctacgcatctgacaaagggctaatatccagaatctacaaagaactcagacaaatttagaagaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtgaactagttcaaccattgtggaagtcagtgtggcgatccctcagggatctagaattagaaataccatttgacccagccatcccattactgggtatatacccaaagaattataaatcatgctgctataaagacacatgcacacgtatgtttattgcagcactattcacaatagcaaagacttggaaccaacccaaatgtccaacaatgatagactggattaagaaaatgtggcacatatacaccatggaaaactatgtagccataaaaaatgatgagttcatgtcctttgtaggaacatggatgaagatggaaaccatcattctcagcaaactttcgcaaggacaaaaaccaaacatcgcgtgttctcactcataggtgggaattgaacaatgagaacacttggacacaggaagaggaacatcacacaccagggcctgttgtggggagggatagcattaggaggtatgcctaatgttaaatgacgagttaacgggtgcagcacaccaacatggcacatgtatacatatgtaacaaacctgcacattgtgcacatgtaccctaaaacttaaagtataatttaaaaaa

SEQ ID NO: 5622 - DNA, 1726 bp, Artificial Sequence; identical to SEQ ID NO: 1284
  Synthetic polypeptide

SEQ ID NO: 5623 - DNA, 807 bp, Artificial Sequence; identical to SEQ ID NO: 1285
  Synthetic polypeptide

SEQ ID NO: 5624 - DNA, 992 bp, Artificial Sequence; identical to SEQ ID NO: 1286
  Synthetic polypeptide

SEQ ID NO: 5625 - DNA, 1326 bp, Artificial Sequence
  Synthetic polypeptide
atgggccgaggggtgcgcgtgctgctgctgctgagcctgctgcactgcgccgggggcagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagctactccggaggctgaggcaggagaatcgcttgaacctgggagacagaggttatggtgagtcgagattgcaacattgcactccatcctgggggcaacaagagtgaaactccatctcaaaaaaaaaagaaaaaaaaaaaaaga

SEQ ID NO: 5626 - DNA, 1889 bp, Artificial Sequence
  Synthetic polypeptide
atggcctatgtccccgcaccgggctaccagcccacctacaacccgacgctgccttactaccagcccatcccgggcgggctcaacgtgggaatgtctgtttacatccaaggagtggccagcgagcacatgaagcggttcttcgtgaactttgtggttgggcaggatccgggctcagacgtcgccttccacttcaatccgcggtttgacggctgggacaaggtggtcttcaacacgttgcagggcgggaagtggggcagcgaggagaggaagaggagcatgcccttcaaaaagggtgccgcctttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgccgcctgccttggcctcccaaagtgccaagagtgcagcctctgcccggccgctaccccgtctgggaagtgaggtgcgtctctgcctggccgcccatcatctgggacgtgaggagtccctctgcctggctgcccagtctggaaagtgaggagcgtctctgcccggccgccatctcacctaggaagtgaggagcacctcttcccggccaccatcccatctaggaagtgaggagcgtctctgcccggccgcccatcgtctgagatgtggggagcgcctctgccccgccgccccgtctgggaggtgaggagcgtctctgcccggccgccccgtctgagaagggaggagaccctccgcctggcaaccgccccatctgagaagtgaggagcccctccgcccggctgccaccctgtctgggaagtgaggagcgtctccgcccggcagccaccccgtccggaagggaggtgggggggtcagccccccgcccggccagccgccccggccagccaccccgtctgggaggtgaggggcgcctctgcccggccgcccctactgggaagtgaggagcccctctgcccggccagccgccccgtccgggagggaggtgggggagtcagccccctgcccagccagccgccccgtccgggagggaggtgggggggtcagccccccgccaggcgagacgccccgtccgggagggaggtggggggtcagccccctgcccggccagccgcccggtccgggaggtgaggggcgcctctgcccggccgcccctactgggaagtgaggagcccctctgcccggccaccaccccgtctgggaggtgtacccaacagctcattgagaacgggccatgatgacaatggcagttttgcggaatagaaaagggggaaaggtggggaaaagattgagaaatcggatggttgctgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagggttaaatggattaagggcggtgcaagatgtgctttgttaaacagatgcttgaaggcagcatgctcgttaagagtcatcaccattccctaatctcaagtacccagggacacacacactctgcctaggaaaaccagagacctttgttcacttgtttatctgctgaccttccctccactattgtcctgtgaccctgccaaatcccccctctgcgagaaacacccaagaatgatcaataaaaaaaaaatacaaaaa

SEQ ID NO: 5627 - DNA, 1573 bp, Artificial Sequence
  Synthetic polypeptide
tgcccttcaaaaagggtgccgcctttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctaccatggaaggacccccaaccttcaacccgccgcctgccttggcctcccaaagtgccaagagtgcagcctctgcccggccgctaccccgtctgggaagtgaggtgcgtctctgcctggccgcccatcatctgggacgtgaggagtccctctgcctggctgcccagtctggaaagtgaggagcgtctctgcccggccgccatctcacctaggaagtgaggagcacctcttcccggccaccatcccatctaggaagtgaggagcgtctctgcccggccgcccatcgtctgagatgtggggagcgcctctgccccgccgccccgtctgggaggtgaggagcgtctctgcccggccgccccgtctgagaagggaggagaccctccgcctggcaaccgccccatctgagaagtgaggagcccctccgcccggctgccaccctgtctgggaagtgaggagcgtctccgcccggcagccaccccgtccggaagggaggtgggggggtcagccccccgcccggccagccgccccggccagccaccccgtctgggaggtgaggggcgcctctgcccggccgcccctactgggaagtgaggagcccctctgcccggccagccgccccgtccgggagggaggtgggggagtcagccccctgcccagccagccgccccgtccgggagggaggtgggggggtcagccccccgccaggcgagacgccccgtccgggagggaggtggggggtcagccccctgcccggccagccgcccggtccgggaggtgaggggcgcctctgcccggccgcccctactgggaagtgaggagcccctctgcccggccaccaccccgtctgggaggtgtacccaacagctcattgagaacgggccatgatgacaatggcagttttgcggaatagaaaagggggaaaggtggggaaaagattgagaaatcggatggttgctgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagggttaaatggattaagggcggtgcaagatgtgctttgttaaacagatgcttgaaggcagcatgctcgttaagagtcatcaccattccctaatctcaagtacccagggacacacacactctgcctaggaaaaccagagacctttgttcacttgtttatctgctgaccttccctccactattgtcctgtgaccctgccaaatcccccctctgcgagaaacacccaagaatgatcaataaaaaaaaaatacaaaaa

SEQ ID NO: 5628 - DNA, 3332 bp, Artificial Sequence
  Synthetic polypeptide
atgttcagctttgtggacctccggctcctgctcctcttagcggccaccgccctcctgacgcacggccaagaggaaggccaagtcgagggccaagacgaagacatcccaccaatcacctgcgtacagaacggcctcaggtaccatgaccgagacgtgtggaaacccgagccctgccggatctgcgtctgcgacaacggcaaggtgttgtgcgatgacgtgatctgtgacgagaccaagaactgccccggcgccgaagtccccgagggcgagtgctgtcccgtctgccccgacggctcagagtcacccaccgaccaagaaaccaccggcgtcgagggacccaagggagacactggcccccgaggcccaaggggacccgcaggcccccctggccgagatggcatccctggacagcctggacttcccggaccccccggaccccccggacctcccggaccccctggcctcggaggaaactttgctccccagctgtcttatggctatgatgagaaatcaaccggaggaatttccgtgcctggccccatgggtccctctggtcctcgtggtctccctggcccccctggtgcacctggtccccaaggcttccaaggtccccctggtgagcctggcgagcctggagcttcaggtcccatgggtccccgaggtcccccaggtccccctggaaagaatggagatgatggggaagctggaaaacctggtcgtcctggtgagcgtgggcctcctgggcctcagggtgctcgaggattgcccggaacagctggcctccctggaatgaagggacacagaggtttcagtggtttggatggtgccaagggagatgctggtcctgctggtcctaagggtgagcctggcagccctggtgaaaatggagctcctggtcagatgggcccccgtggcctgcctggtgagagaggtcgccctggagcccctggccctgctggtgctcgtggaaatgatggtgctactggtgctgccgggccccctggtcccaccggccccgctggtcctcctggcttccctggtgctgttggtgctaagggtgaagctggtccccaagggccccgaggctctgaaggtccccagggtgtgcgtggtgagcctggcccccctggccctgctggtgctgctggccctgctggaaaccctggtgctgatggacagcctggtgctaaaggtgccaatggtgctcctggtattgctggtgctcctggcttccctggtgcccgaggcccctctggaccccagggccccggcggccctcctggtcccaagggtaacagcggtgaacctggtgctcctggcagcaaaggagacactggtgctaagggagagcctggccctgttggtgttcaaggaccccctggccctgctggagaggaaggaaagcgaggagctcgaggtgaacccggacccactggcctgcccggaccccctggcgagcgtggtggacctggtagccgtggtttccctggcgcagatggtgttgctggtcccaagggtcccgctggtgaacgtggttctcctggccctgctggccccaaaggatctcctggtgaagctggtcgtcccggtgaagctggtctgcctggtgccaagggtctgactggaagccctggcagccctggtcctgatggcaaaactggcccccctggtcccgccggtcaagatggtcgccccggacccccaggcccacctggtgcccgtggtcaggctggtgtgatgggattccctggacctaaaggtgctgctggagagcccggcaaggctggagagcgaggtgttcccggaccccctggcgctgtcggtcctgctggcaaagatggagaggctggagctcagggaccccctggccctgctggtcccgctggcgagagaggtgaacaaggccctgctggctcccccggattccagggtctccctggtcctgctggtcctccaggtgaagcaggcaaacctggtgaacagggtgttcctggagaccttggcgcccctggcccctctggagcaagaggcgagagaggtttccctggcgagcgtggtgtgcaaggtccccctggtcctgctggtccccgaggggccaacggtgctcccggcaacgatggtgctaagggtgatgctggtgcccctggagctcccggtagccagggcgcccctggccttcagggaatgcctggtgaacgtggtgcagctggtcttccagggcctaagggtgacagaggtgatgctggtcccaaaggtgctgatggctctcctggcaaagatggcgtccgtggtctgactggccccattggtcctcctggccctgctggtgcccctggtgacaagggtgaaagtggtcccagcggccctgctggtcccactggagctcgtggtgcccccggagaccgtggtgagcctggtccccccggccctgctggctttgctggcccccctggtgctgacggccaacctggtgctaaaggcgaacctggtgatgctggtgctaaaggcgatgctggtccccctggccctgccggacccgctggaccccctggccccattggtaatgttggtgctcctggagccaaaggtgctcgcggcagcgctggtccccctggtgctactggtttccctggtgctgctggccgagtcggtcctcctggcccctctggaaatgctggaccccctggccctcctggtcctgctggcaaagaaggcggcaaaggtccccgtggtgagactggccctgctggacgtcctggtgaagttggtccccctggtccccctggccctgctggcgagaaaggatcccctggtgctgatggtcctgctggtgctcctggtactcccgggcctcaaggtattgctggacagcgtggtgtggtcggcctgcctggtcagagaggagagagaggcttccctggtcttcctggcccctctggtgaacctggcaaacaaggtccctctggagcaagtggtgaacgtggtccccctggtcccatgggcccccctggattggctggaccccctggtgaatctggacgcacgggggctcacacctgtaatcccagcactttgggaggccgaggtgggtagatcacgagatcaggagttccagaccagcctggccaacatggtgaaaccccatctctactaaaaataattagctgggcgtcgtggtgggcacctgtaatcccagctaatcaggaggctgaggcaggagaatctcttgaacccgggaggcagaggttgcagtgagttgagatcacgccattgcactccagcctgggtgacagagcgagactccgtctcaaaaaaaaaaatttaaaaaagaa

SEQ ID NO: 5629 - DNA, 610 bp, Artificial Sequence; identical to SEQ ID NO: 163
  Synthetic polypeptide

SEQ ID NO: 5630 - DNA, 4988 bp, Artificial Sequence
  Synthetic polypeptide
atgtctcgatcccgccatgcaaggccttccagattagtcaggaaggaagatgtaaacaaaaaaaagaaaaacagccaactacgaaagacaaccaagggagccaacaaaaatgtggcatcagtcaagactttaagccctggaaaattaaagcaattaattcaagaaagagatgttaagaaaaaaacagaacctaaaccacccgtgccagtcagaagccttctgacaagagctggagcagcacgcatgaatttggataggactgaggttctttttcagaacccagagtccttaacctgcaatgggtttacaatggcgctacgaagcacctctcttagcaggcgactctcccaacccccactggtcgtagccaaatccaaaaaggttccactttctaagggtttagaaaagcaacatgattgtgattataagatactccctgctttgggagtaaagcactcagaaaatgattcggttccaatgcaagacacccaagtccttcctgatatagagactctaattggtgtacaaaatccctctttacttaaaggtaagagccaagagacaactcagttttggtcccaaagagttgaggattccaagatcaatatccctacccacagtggccctgcagctgagatccttcctgggccactggaagggacacgctgtggtgaaggactattctctgaagagacattgaatgataccagtggttccccaaaaatgtttgctcaggacacagtgtgtgctccttttccccaaagagcaacccccaaagttacctctcaaggaaaccccagcattcagttagaagagttgggttcacgagtagaatctcttaagttatctgattcttacctggatcccattaaaagtgaacatgattgctaccccacctccagtcttaataaggttatacctgacttgaaccttagaaactgcttggctcttggtgggtctacgtctcctacctctgtaataaaattcctcttggcaggctcaaaacaagcgacccttggtgctaaaccagatcatcaagaggccttcgaagctactgcaaatcaacaggaagtttctgataccacctctttcctaggacaggcctttggtgctatcccacatcaatgggaacttcctggtgctgacccagttcatggtgaggccctgggtgagaccccagatctaccagagattcctggtgctattccagtccaaggagaggtctttggtactattttagaccaacaagaaactcttggtatgagtgggagtgttgtcccagacttgcctgtcttccttcctgttcctccaaatccaattgctacctttaatgctccttccaaatggcctgagccccaaagcactgtctcatatggacttgcagtccagggtgctatacagattttgcctttgggctcaggacacactcctcaatcatcatcaaactcagagaaaaattcattacctccagtaatggctataagcaatgtagaaaatgagaagcaggttcatataagcttcctgccagctaacactcaggggttcccattagcccctgagagaggactcttccatgcttcactgggtatagcccaactctctcaggctggtcctagcaaatcagacagagggagctcccaggtcagtgtaaccagcacagttcatgttgtcaacaccacagtggtgactatgccagtgccaatggtcagtacctcctcttcttcctataccactttgctaccgactttggaaaagaagaaaagaaagcgatgtggggtctgtgaaccctgccagcagaagaccaactgtggtgaatgcacttactgcaagaacagaaagaacagccatcagatctgtaagaaaagaaaatgtgaggagctgaaaaagaaaccatctgttgttgtgcctctggaggttataaaggaaaacaagaggccccagagggaaaagaagcccaaagttttaaaggcagattttgacaacaaaccagtaaatggccccaagtcagaatccatggactacagtagatgtggtcatggggaagaacaaaaattggaattgaacccacatactgttgaaaatgtaactaaaaatgaagacagcatgacaggcatcgaggtggagaagtggacacaaaacaagaaatcacagttaactgatcacgtgaaaggagattttagtgctaatgtcccagaagctgaaaaatcgaaaaactctgaagttgacaagaaacgaaccaaatctccaaaattgtttgtacaaaccgtaagaaatggcattaaacatgtacactgtttaccagctgaaacaaatgtttcatttaaaaaattcaatattgaagaattcggcaagacattggaaaacaattcttataaattcctaaaagacactgcaaaccataaaaacgctatgagctctgttgctactgatatgagttgtgatcatctcaaggggagaagtaacgttttagtattccagcagcctggctttaactgcagttccattccacattcttcacactccatcataaatcatcatgctagtatacacaatgaaggtgatcaaccaaaaactcctgagaatataccaagtaaagaaccaaaagatggatctcccgttcaaccaagtctcttatcgttaatgaaagataggagattaacattggagcaagtggtagccatagaggccctgactcaactctcagaagccccatcagagaattcctccccatcaaagtcagagaaggatgaggaatcagagcagagaacagccagtttgcttaatagctgcaaagctatcctctacactgtaagaaaagacctccaagacccaaacttacagggagagccaccaaaacttaatcactgtccatctttggaaaaacaaagttcatgcaacacggtggttttcaatgggcaaactactaccctttccaactcacatatcaactcagctactaaccaagcatccacaaagtcacatgaatattcaaaagtcacaaattcattatctctttttataccaaaatcaaattcatccaagattgacaccaataaaagtattgctcaagggataattactcttgacaattgttccaatgatttgcatcagttgccaccaagaaataatgaagtggagtattgcaaccagttactggacagcagcaaaaaattggactcagatgatctatcatgtcaggatgcaacccatacccaaattgaggaagatgttgcaacacagttgacacaacttgcttcgataattaagatcaattatataaaaccagaggacaaaaaagttgaaagtacaccaacaagccttgtcacatgtaatgtacagcaaaaatacaatcaggagaagggcacaatacaacagaaaccaccttcaagtgtacacaataatcatggttcatcattaacaaaacaaaagaacccaacccagaaaaagacaaaatccaccccatcaagagatcggcggaaaaagaagcccacagttgtaagttatcaagaaaatgatcggcagaagtgggaaaagttgtcctatatgtatggcacaatatgcgacatttggatagcatcgaaatttcaaaattttgggcaattttgtccacatgattttcctactgtatttgggaaaatttcttcctcgaccaaaatatggaaaccactggctcaaacgaggtccattatgcaacccaaaacagtatttccaccactcactcagataaaattacagagatatcctgaatcagcagaggaaaaggtgaaggttgaaccattggattcactcagcttatttcatcttaaaacggaatccaacgggaaggcattcactgataaagcttataattctcaggtacagttaacggtgaatgccaatcagaaagcccatcctttgacccagccctcctctccacctaaccagtgtgctaacgtgatggcaggcgatgaccaaatacggtttcagcaggttgttaaggagcaactcatgcatcagagactgccaacattgcctggtatctctcatgaaacacccttaccggagtcagcactaactctcaggaatgtaaatgtagtgtgttcaggtggaattacagtggtttctaccaaaagtgaagaggaagtctgttcatccagttttggaacatcagaattttccacagtggacagtgcacagaaaaattttaatgattatgccatgaacttctttactaaccctacaaaaaacctagtgtctataactaaagattctgaactgcccacctgcagctgtcttgatcgagttatacaaaaagacaaaggcccatattatacacaccttggggcaggaccaagtgttgctgctgtcagggaaatcatggagaataggtatggtcaaaaaggaaacgcaataaggatagaaatagtagtgtacaccggtaaagaagggaaaagctctcatgggtgtccaattgctaagtgggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaatcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatacctactatgaaagaattactaaaggacgtaatccagaaagaagatatatgaaaccggaacgaatcagtccgggacacgaggccatggtgagcaaagaaattagtcgaacttggtgttaagttaaataagttcaatacttatatattatattaaattaaaataa

SEQ ID NO: 5631 - DNA, 806 bp, Artificial Sequence; identical to SEQ ID NO: 974
  Synthetic polypeptide

SEQ ID NO: 5632 - DNA, 822 bp, Artificial Sequence; identical to SEQ ID NO: 119
  Synthetic polypeptide

SEQ ID NO: 5633 - DNA, 589 bp, Artificial Sequence
  Synthetic polypeptide
atggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagcgtatgaggacaaggcattcatcctctccggaggacacagcaacaaggtgccatcttggacgcagagagcagctctcaccagacactgaacctgccagcaccttaatcttagatcttcagcctccagaactgtgatcaataaatttgtgtgtttttataaatt

SEQ ID NO: 5634 - DNA, 775 bp, Artificial Sequence; identical to SEQ ID NO: 215
  Synthetic polypeptide

SEQ ID NO: 5635 - DNA, 2362 bp, Artificial Sequence; identical to SEQ ID NO: 1664
  Synthetic polypeptide

SEQ ID NO: 5636 - DNA, 2113 bp, Artificial Sequence; identical to SEQ ID NO: 1665
  Synthetic polypeptide

SEQ ID NO: 5637 - DNA, 1399 bp, Artificial Sequence; identical to SEQ ID NO: 1666
  Synthetic polypeptide

SEQ ID NO: 5638 - DNA, 2080 bp, Artificial Sequence; identical to SEQ ID NO: 1667
  Synthetic polypeptide

SEQ ID NO: 5639 - DNA, 1761 bp, Artificial Sequence; identical to SEQ ID NO: 3913
  Synthetic polypeptide

SEQ ID NO: 5640 - DNA, 1563 bp, Artificial Sequence; identical to SEQ ID NO: 3914
  Synthetic polypeptide

SEQ ID NO: 5641 - DNA, 500 bp, Artificial Sequence; identical to SEQ ID NO: 204
  Synthetic polypeptide

SEQ ID NO: 5642 - DNA, 656 bp, Artificial Sequence; identical to SEQ ID NO: 205
  Synthetic polypeptide

SEQ ID NO: 5643 - DNA, 524 bp, Artificial Sequence; identical to SEQ ID NO: 207
  Synthetic polypeptide

SEQ ID NO: 5644 - DNA, 628 bp, Artificial Sequence; identical to SEQ ID NO: 2222
  Synthetic polypeptide

SEQ ID NO: 5645 - DNA, 1221 bp, Artificial Sequence; identical to SEQ ID NO: 122
  Synthetic polypeptide

SEQ ID NO: 5646 - DNA, 572 bp, Artificial Sequence; identical to SEQ ID NO: 159
  Synthetic polypeptide

SEQ ID NO: 5647 - DNA, 904 bp, Artificial Sequence
  Synthetic polypeptide
atgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctagctgagcatggtagttcacgcctataatcccagcactttggggaacc

SEQ ID NO: 5648 - DNA, 1072 bp, Artificial Sequence
  Synthetic polypeptide
atggcggccaacatgtaccgggtcggagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctagctgagcatggtagttcacgcctataatcccagcactttggggaacc

SEQ ID NO: 5649 - DNA, 2389 bp, Artificial Sequence
  Synthetic polypeptide
atggactcggaatattacagcggcgaccagtcagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacagaatgaagatgaaataaggagggaattaattaacagtgtaccagctgaaggaaatacagaaggaaagaaatgcaagaaagaatgatctcagatggaaggttagagatgcaggagggagaaaagagcaacaaaagtatgtgtataagtctaaatgagtattgactatacaaaatgaaatgtatttaatgtggaatatatataaaattaaaacatgacagcagtaaattgggagcatacgtggaattgaagtgctcataggcctttgcaaatgtgtatgaatgtacattagtaaactgataagttagggtgcatgttgtagtctctaaagtgaccactaacaagactaaaatggaatgtgtaatttctaaactaatagggggggaaagtggaacaactagaactaatcagtcgaaaatgagcaggaaaagagaaagaactataggacaagggacaattagaaagtattacatggtaaaatagtagatttaaattttgataatatcagaaattaaattaaatgtaaatagtaaatattccagttaaaggacaacaattgccagacaggatcttaaaaaccagccatatactgatgtcaagagatttgtctgaaacagaaggtaaagctgaaaataaaggtgtatgaaaggggactttgtgtaaacatggaccaaaagaaaattgttgtggtatctataatattataaaagagggaggtagacattaaggcaaaaaaaagtacttaagataaagaggtcactttatatcgataaaaagattttaaaattgtttgcgcctaataacatggctttatagatatatgcacacttaaaaatcaaaaattgatagaactgaaaagagaaatggacaagtccataatctaagagaaatgtaactgacagaagaagcagatcgaaaaaaccag

SEQ ID NO: 5650 - DNA, 2410 bp, Artificial Sequence
  Synthetic polypeptide
atgcctgcccgcccgccagcctgccgggtacggccttttccgccggggcttccagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacagaatgaagatgaaataaggagggaattaattaacagtgtaccagctgaaggaaatacagaaggaaagaaatgcaagaaagaatgatctcagatggaaggttagagatgcaggagggagaaaagagcaacaaaagtatgtgtataagtctaaatgagtattgactatacaaaatgaaatgtatttaatgtggaatatatataaaattaaaacatgacagcagtaaattgggagcatacgtggaattgaagtgctcataggcctttgcaaatgtgtatgaatgtacattagtaaactgataagttagggtgcatgttgtagtctctaaagtgaccactaacaagactaaaatggaatgtgtaatttctaaactaatagggggggaaagtggaacaactagaactaatcagtcgaaaatgagcaggaaaagagaaagaactataggacaagggacaattagaaagtattacatggtaaaatagtagatttaaattttgataatatcagaaattaaattaaatgtaaatagtaaatattccagttaaaggacaacaattgccagacaggatcttaaaaaccagccatatactgatgtcaagagatttgtctgaaacagaaggtaaagctgaaaataaaggtgtatgaaaggggactttgtgtaaacatggaccaaaagaaaattgttgtggtatctataatattataaaagagggaggtagacattaaggcaaaaaaaagtacttaagataaagaggtcactttatatcgataaaaagattttaaaattgtttgcgcctaataacatggctttatagatatatgcacacttaaaaatcaaaaattgatagaactgaaaagagaaatggacaagtccataatctaagagaaatgtaactgacagaagaagcagatcgaaaaaaccag

SEQ ID NO: 5651 - DNA, 95 bp, Artificial Sequence; identical to SEQ ID NO: 1917
  Synthetic polypeptide

SEQ ID NO: 5652 - DNA, 1146 bp, Artificial Sequence; identical to SEQ ID NO: 988
  Synthetic polypeptide

SEQ ID NO: 5653 - DNA, 2721 bp, Artificial Sequence; identical to SEQ ID NO: 962
  Synthetic polypeptide

SEQ ID NO: 5654 - DNA, 2549 bp, Artificial Sequence; identical to SEQ ID NO: 963
  Synthetic polypeptide

SEQ ID NO: 5655 - DNA, 1052 bp, Artificial Sequence; identical to SEQ ID NO: 247
  Synthetic polypeptide

SEQ ID NO: 5656 - DNA, 327 bp, Artificial Sequence; identical to SEQ ID NO: 246
  Synthetic polypeptide

SEQ ID NO: 5657 - DNA, 1398 bp, Artificial Sequence; identical to SEQ ID NO: 948
  Synthetic polypeptide

SEQ ID NO: 5658 - DNA, 1302 bp, Artificial Sequence; identical to SEQ ID NO: 949
  Synthetic polypeptide

SEQ ID NO: 5659 - DNA, 770 bp, Artificial Sequence; identical to SEQ ID NO: 3389
  Synthetic polypeptide

SEQ ID NO: 5660 - DNA, 103 bp, Artificial Sequence; identical to SEQ ID NO: 173
  Synthetic polypeptide

SEQ ID NO: 5661 - DNA, 802 bp, Artificial Sequence; identical to SEQ ID NO: 2212
  Synthetic polypeptide

SEQ ID NO: 5662 - DNA, 2141 bp, Artificial Sequence; identical to SEQ ID NO: 2213
  Synthetic polypeptide

SEQ ID NO: 5663 - DNA, 2192 bp, Artificial Sequence; identical to SEQ ID NO: 2214
  Synthetic polypeptide

SEQ ID NO: 5664 - DNA, 2015 bp, Artificial Sequence; identical to SEQ ID NO: 2215
  Synthetic polypeptide

SEQ ID NO: 5665 - DNA, 276 bp, Artificial Sequence; identical to SEQ ID NO: 923
  Synthetic polypeptide

SEQ ID NO: 5666 - DNA, 1420 bp, Artificial Sequence; identical to SEQ ID NO: 924
  Synthetic polypeptide

SEQ ID NO: 5667 - DNA, 1336 bp, Artificial Sequence; identical to SEQ ID NO: 925
  Synthetic polypeptide

SEQ ID NO: 5668 - DNA, 1069 bp, Artificial Sequence; identical to SEQ ID NO: 926
  Synthetic polypeptide

SEQ ID NO: 5669 - DNA, 1345 bp, Artificial Sequence; identical to SEQ ID NO: 927
  Synthetic polypeptide

SEQ ID NO: 5670 - DNA, 409 bp, Artificial Sequence
  Synthetic polypeptide
atggcggaggatgtttcctcagcggccccgagcccgcggggctgtgcggatggtagggatgccgaccctactgaggagcagatggcagaaacagagagaaacgacgaggagcagttcgaatgccaggaactgctcgagtgccaggtgcaggtgggggcccccgaggaggaggaggaggaggaggaggacgcgggcctggtggccgaggccgaggccgtggctgccggctggatgctcgatttcctctgcctctctctttgccgagctttccgcgacggccgctccgaggacttccgcaggacccgcaacagcgcagaggattaaaaccttcatgggggcagagactggctatctgaagtcatcacctcctaacacaggctggcagtagatgttcagtaaatattgaatg

SEQ ID NO: 5671 - DNA, 1834 bp, Artificial Sequence; identical to SEQ ID NO: 133
  Synthetic polypeptide

SEQ ID NO: 5672 - DNA, 1765 bp, Artificial Sequence; identical to SEQ ID NO: 135
  Synthetic polypeptide

SEQ ID NO: 5673 - DNA, 2107 bp, Artificial Sequence
  Synthetic polypeptide
atggctcggaaattagtgatgttcagggatgttgccattgacttctctcaggaagagtgggaatgcctggactctgctcagagagatttgtatagagatgtgatgttggagaactatagcaacttggtatcactagacttgccttcaaggtgtgcaagtaaggacttatctccagaaaagaacacttatgaaacagaattatcccaatgggaaatgagtgacagacttgaaaactgtgatcttgaagagtccaattccagggattatttggaagccaaaggcaagatggagaagcaacaagaaaatcagaaggaatatttcaggcaagggatgatcatatatgacaaaatgtccattttcaaccagcatacttacttatctcaacattcaagatgtcattctactgagaaaccctataaatgtaaggaatgtgggaaagccttcagacgagcctcacacctaacacaacatcaaagtattcatactggtgaaaaaccctatgaatgtaagcaatgcgggaaggcctttagtcgtgattcacaactcagtcttcatcagagacttcatactggtgagaaaccctatgcatgtaaggaatgtgggaaggcctttactcaaagctcacaacttattttacatcatagaattcatactggtgaaaaaccatataaatgtgaagaatgtgggaaagcctttattcgtagctcacaacttacccgacatcaaaaagttcatactggtgagaaaccttatgaatgtaaagaatgtgggaaggcctttactcagaattcacaacttacactacaccagagacttcatactggtgaaaagctctatgaatgtaaagaatgtaggaaggtctttactcagctctcacaacttattctgcataagagaattcataccggtgagaaaccctatgaatgtaaggaatgtggaaaagcttttatttgtggctcacagctttctcaacatcagaaaattcataatggggaaaaaccatatgaatgtaaggaatgtggaagggcctttattcggggctcactactgatgcaacatcagaggattcatactggtgaaaaaccctataaatgtgaagaatgtgggaaggcctttatccgtggctcacaacttactcaacaccagagaattcacaccaatgaaaagccctatgaatgtaaggaatgtggaaagatgtttagtcatggctcacaacttactcaacatcagagaatacacactggtgagaaaccctatcaatgtaaggaatgtggaaaagcgtttaatcgtggctcactccttacacgacaccagaggattcatactggtgagaaaccctatgaatgtaaagaatgtggaaaaacctttagtcgtggctcagaacttactcaacatgagcgaattcacacaggtgagaaaccctatgaatgtaaggaatgtgggaaatcttttattcgtggttcccagcttactcaacatcagagaatccatactggtgagaaaccttatgaatgtaaagaatgtagaatggcctttactcagagttcacatctttcccaacatcaaagacttcacactggtgagaaaccctatgtgtgtaatgaatgtggaaaggcctttgcgcgtggcttactacttatacaacatcagagaattcatactggtgagaaaccatatcaatgtaaggaatgtgggaaagcctttattcgtggttcacagttgactcaacatcagcgaattcacactggagaaaaaccctatgaatgcaaggagtgtggcaaggcctttagtcatggctctcagcttactctacatcagagaatccatactggtgagaagccctatgaatgcagagaatgtagaaaggcctttactcagagttcacatctttctcggcatcagagaattcatactgctggagctccgttactctcatggggactttgagaatggtatctgggtgttatggatcatggagcagaaatacagaaggagtctgcaaccctgatgactttgtggaacagccatactagctctggtctgcttgcctcctgtttctctttaaataaaattaaacatcttatttgttgatgctattgtagttctg

SEQ ID NO: 5674 - DNA, 681 bp, Artificial Sequence; identical to SEQ ID NO: 1642
  Synthetic polypeptide

SEQ ID NO: 5675 - DNA, 534 bp, Artificial Sequence; identical to SEQ ID NO: 1643
  Synthetic polypeptide

SEQ ID NO: 5676 - DNA, 270 bp, Artificial Sequence; identical to SEQ ID NO: 1644
  Synthetic polypeptide

SEQ ID NO: 5677 - DNA, 596 bp, Artificial Sequence; identical to SEQ ID NO: 1645
  Synthetic polypeptide

SEQ ID NO: 5678 - DNA, 5237 bp, Artificial Sequence; identical to SEQ ID NO: 3991
  Synthetic polypeptide

SEQ ID NO: 5679 - DNA, 7292 bp, Artificial Sequence; identical to SEQ ID NO: 3992
  Synthetic polypeptide

SEQ ID NO: 5680 - DNA, 980 bp, Artificial Sequence; identical to SEQ ID NO: 139
  Synthetic polypeptide

SEQ ID NO: 5681 - DNA, 1256 bp, Artificial Sequence; identical to SEQ ID NO: 140
  Synthetic polypeptide

SEQ ID NO: 5682 - DNA, 1277 bp, Artificial Sequence; identical to SEQ ID NO: 142
  Synthetic polypeptide

SEQ ID NO: 5683 - DNA, 995 bp, Artificial Sequence
  Synthetic polypeptide
atggcagataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatggaaaacaggactaggaaggtcttcaatctgaaaaagatatctatgagaaggctgaagaaaacatcacaatcaatggtgaaataaaaaagcatttgctttgagattgggacaagaaggatcatccccgcttccatttaacattgtattgtaagaagtatccagtgcattaaagagaataaaagaaaaaaaattaagataaagcaataaaactctcattcatttatgatgtgattatgcatatttaattcaaaagaatctatagatcagttttatagatctttttttaaatcagaattttgttaggttactgccaaaaaacaaacaagaatttctatataccaaaaaagaaaaaacagaaaataaaatgtgaaaaata

SEQ ID NO: 5684 - DNA, 866 bp, Artificial Sequence
  Synthetic polypeptide
atggcagataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccagtcaagtaaagaacagtttgccagtacaaacattgctgaagagctagtaaaactcttcaagaaacaaatagaacatgataagagagaaatgatttttgaagttcttgctccattggcagaaaatggaaaacaggactaggaaggtcttcaatctgaaaaagatatctatgagaaggctgaagaaaacatcacaatcaatggtgaaataaaaaagcatttgctttgagattgggacaagaaggatcatccccgcttccatttaacattgtattgtaagaagtatccagtgcattaaagagaataaaagaaaaaaaattaagataaagcaataaaactctcattcatttatgatgtgattatgcatatttaattcaaaagaatctatagatcagttttatagatctttttttaaatcagaattttgttaggttactgccaaaaaacaaacaagaatttctatataccaaaaaagaaaaaacagaaaataaaatgtgaaaaata

SEQ ID NO: 5685 - DNA, 1139 bp, Artificial Sequence
  Synthetic polypeptide
atggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatggaaaacaggactaggaaggtcttcaatctgaaaaagatatctatgagaaggctgaagaaaacatcacaatcaatggtgaaataaaaaagcatttgctttgagattgggacaagaaggatcatccccgcttccatttaacattgtattgtaagaagtatccagtgcattaaagagaataaaagaaaaaaaattaagataaagcaataaaactctcattcatttatgatgtgattatgcatatttaattcaaaagaatctatagatcagttttatagatctttttttaaatcagaattttgttaggttactgccaaaaaacaaacaagaatttctatataccaaaaaagaaaaaacagaaaataaaatgtgaaaaata

SEQ ID NO: 5686 - DNA, 1142 bp, Artificial Sequence
  Synthetic polypeptide
atggcagataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatggaaaacaggactaggaaggtcttcaatctgaaaaagatatctatgagaaggctgaagaaaacatcacaatcaatggtgaaataaaaaagcatttgctttgagattgggacaagaaggatcatccccgcttccatttaacattgtattgtaagaagtatccagtgcattaaagagaataaaagaaaaaaaattaagataaagcaataaaactctcattcatttatgatgtgattatgcatatttaattcaaaagaatctatagatcagttttatagatctttttttaaatcagaattttgttaggttactgccaaaaaacaaacaagaatttctatataccaaaaaagaaaaaacagaaaataaaatgtgaaaaata

SEQ ID NO: 5687 - DNA, 992 bp, Artificial Sequence
  Synthetic polypeptide
atggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatggaaaacaggactaggaaggtcttcaatctgaaaaagatatctatgagaaggctgaagaaaacatcacaatcaatggtgaaataaaaaagcatttgctttgagattgggacaagaaggatcatccccgcttccatttaacattgtattgtaagaagtatccagtgcattaaagagaataaaagaaaaaaaattaagataaagcaataaaactctcattcatttatgatgtgattatgcatatttaattcaaaagaatctatagatcagttttatagatctttttttaaatcagaattttgttaggttactgccaaaaaacaaacaagaatttctatataccaaaaaagaaaaaacagaaaataaaatgtgaaaaata

SEQ ID NO: 5688 - DNA, 292 bp, Artificial Sequence
  Synthetic polypeptide
atggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctgtggagttcgtaagctggattattgagtattcacacacgtgtgtgagatgtgccacccttgaaccttgttacaacgtgggcacattattcacttgacatg

SEQ ID NO: 5689 - DNA, 329 bp, Artificial Sequence
  Synthetic polypeptide
cgtggacgagttggaggacgaggaggagggggcggagactcggggcgccggggacccggcccggtacctcagccccggctggggcagcgcgagcgaggaggagccgagccgcgggcacagaactgcccagctcccgtggcttgagtctcagcaagtgttcagtctgaagcccttcctgctgcccactggcatagagttgaccccagaaaatccctggggttcttcggaataggagctcggtgaattcaaggaccatgcttgcttcgttcattgtatcttcagcacctagcacagcacccagcacataggacatgtttgttgactgaatg

SEQ ID NO: 5690 - DNA, 586 bp, Artificial Sequence; identical to SEQ ID NO: 401
  Synthetic polypeptide

SEQ ID NO: 5691 - DNA, 829 bp, Artificial Sequence; identical to SEQ ID NO: 402
  Synthetic polypeptide

SEQ ID NO: 5692 - DNA, 1060 bp, Artificial Sequence; identical to SEQ ID NO: 403
  Synthetic polypeptide

SEQ ID NO: 5693 - DNA, 730 bp, Artificial Sequence; identical to SEQ ID NO: 406
  Synthetic polypeptide

SEQ ID NO: 5694 - DNA, 496 bp, Artificial Sequence; identical to SEQ ID NO: 408
  Synthetic polypeptide

SEQ ID NO: 5695 - DNA, 4340 bp, Artificial Sequence
  Synthetic polypeptide
atgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctggccctctttggattccagtacgatgcatcagaccataccatggcgtggctaggacccaacacagtaccagaagtgaaggaaatgatcctgcaggacccgcagctccagacaacacagcttcctcagacgacacaagccccggacattacctgggggatgctgaagaagacaacttacaaggctgagcaaatcctgctccagacacagaaaccattcactccagataatttgttccttgctctgctctctggtgtaagttacaactcacgtaggatcctttttatgctctcgcttcccctgcaacccgtaccggctacactctattgggctcatctgttagatccgcctttcttacgccctgttacctgggcaggcacccccttcccagcctctaataacgttaactgcttggctaggagggattgacttatcccagtagggtccgttattaatggcacacattggactaaggtgccaggtaacactacatatcactccattatcttcccactgtgtgtaaggttactatgtacctgccgaaacacaattatggctacaaatggcaaaggaattgccttaacattcttgtgccagtagcctcaaaccgggcaaggcaatcagtgccactttccccagcattcttccctgtgctaaagaacaaagccaggaaagtaatggattccactttggttgggaggtctgtcacgggggacaagcccttagtctccagttaggcaatttaacatcttagactggagcccccacggtcatttacagggcgaccatactgatgtttgcatccattgtggtgtcaatcttagtttcatagccatgtccgttcccctgtgatttgggccaaaggggggatgggatatcccagaccccaagtagagtccttgccaccccaagacacttaatggcatctgggacatcttagcaccacccttaacacctggcatgggacataacataattccagtaacaattatactatgacctttatgcataatcacacagatcagtgcctgatttgcactacccatccatatgtttttcttatgggaaccagtatttccattacacctcaaaactccatgtttgtgacctgagtgcaaggacaggcttgcttcacctcatgtatcattaattacaatatatctaatttaaatattactagtattatggtattaaggagacaatctgaggcattcctaccagtcagtttgatacacgattggcaaggttcctttgctcttgccaccttagaacatgccctgtcccaggtcagacaccaaagattcatagttaatcttacagcctttatagtctcagccatagtcatcctagcaactgctagttttgctgtagcatctattactgaatcagtacaaatagctgcttttgtagataacttggccagaaatgtgtctaatgaacttctcttacagcagggtacaaatcaaaaggttcttgcacatctgcaagccctcgaggctgccttggaacatgtaggggagtgacaagatgcgctggcattctgacagcaattaaactgtgactgggagcataagcatatctgtgtcacctctctaccatggaaccaatcaatacatagttgggatgaggtgaaacaacacctcggggtgaccttacatgataatttaacagcagacgtaaagcaacttaaaactaaaattctagaatccctaaacgccatagatctacatgtccaacaaacagttatatggaaggatgtgcaagaacatctctcctggatagaccctcactccttgattggaaaaaaatattactaattatactcatgtttgtcttatgttatttactaattctaggatgcaaagccggaatacgagcagtaatcgctacgcctgacaaacctgctgctgtgcacatctgtactcttcaatcaacaaaacctgatgcaaaaaacaaaagggggaga

SEQ ID NO: 5696 - DNA, 1034 bp, Artificial Sequence; identical to SEQ ID NO: 4670
  Synthetic polypeptide

SEQ ID NO: 5697 - DNA, 1586 bp, Artificial Sequence; identical to SEQ ID NO: 4671
  Synthetic polypeptide

SEQ ID NO: 5698 - DNA, 1588 bp, Artificial Sequence; identical to SEQ ID NO: 4672
  Synthetic polypeptide

SEQ ID NO: 5699 - DNA, 1605 bp, Artificial Sequence
  Synthetic polypeptide
atggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggtcaaacagtaaattgttaagaggctaggctactgggtgactttcttgacagaagttcttgcaaaacgtcagagttgaagtggaccatagcctaacagatctcagtggagtgctttctggtatgtcatgctcagcctcactgatggaaatagtgtccaaatcagaggatgtgtaatccatgttgacggtcaggaatggaccctgcattcagtcttgagatcatcccattgaggatagttagggtgctgaagggcacagtgtggggagtatgagtgttcttggaaagagaaggataaggtagctagtgatgtttgccttccaacatttgagggattttcttgcagaagagaaagcagtaaggactttttatcccagagggcagaactagaaacactagcacacatgacgtgggaccagtttcagctcagcacagctaagaa

SEQ ID NO: 5700 - DNA, 2466 bp, Artificial Sequence; identical to SEQ ID NO: 1682
  Synthetic polypeptide

SEQ ID NO: 5701 - DNA, 1806 bp, Artificial Sequence; identical to SEQ ID NO: 1683
  Synthetic polypeptide

SEQ ID NO: 5702 - DNA, 2412 bp, Artificial Sequence; identical to SEQ ID NO: 1684
  Synthetic polypeptide

SEQ ID NO: 5703 - DNA, 2211 bp, Artificial Sequence; identical to SEQ ID NO: 1685
  Synthetic polypeptide

SEQ ID NO: 5704 - DNA, 364 bp, Artificial Sequence; identical to SEQ ID NO: 1686
  Synthetic polypeptide

SEQ ID NO: 5705 - DNA, 317 bp, Artificial Sequence; identical to SEQ ID NO: 995
  Synthetic polypeptide

SEQ ID NO: 5706 - DNA, 3520 bp, Artificial Sequence
  Synthetic polypeptide
atggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaaggcttcgaacatcagtcagtgaaggaccctgcaagactgaaaaaaagtcactacagttatctcagcctactgccttgaaaaagtttctattccagagcagggaaggaagagcccaggcagagcttgggagattgtggagtgaggagaccaagctgagagtgtggagagacccaaatgtcaagaatttccaaggcggagttctggagaggagagagctgcggagagaagagtctgaagataacgggtgattcccctggatgatttcgcagagcactgtgtgtgaggaaactcacccaggctgaggaatgacccaccacgaaggatcagagggagtggacccgggaactcacacaggcctgggaatgtctgttcctgccagccagctggaaagccttataattcaaggggttttgggtacagtacaaaaaaggcgcttgcctcagtcctggaggataattagccctagactaagtgcttctcttacctcacctgtcagatcttaagagcaggatctgagaagatccaattgtttcaaggtaacttaactgcatcccacaacacacttcaagaatgtttataggaatacaaattcatccagcacccaatatgttaaattttacattatctggcatccaatccaaattatgagaca

SEQ ID NO: 5707 - DNA, 4684 bp, Artificial Sequence
  Synthetic polypeptide
atggacggcgatggcggccgccgagacgtccccggcacgctgatggagcccgggcgcggcgcggggcccgcgggcatggcggagcctcgggcgaaggcggcgcggccggggccccagcgctttctgcggcgcagcgtggtagagtcggaccaggaggagccgccgggcttggaggcagccgaggcgccgggcccgcagcccccgcagcccctgcagcgccgggtgcttctgctctgcaagacgcgccgcctcatcgcggagcgcgcccgcggacgccccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggaccggaagctcaccaagctggagcggcagcggttcaaggaagaggctgagatgctgaaaggcctgcagcaccccaacatcgtgcgcttctacgacttctgggagtccagcgccaagggcaagcggtgcattgtgctggtgacggagctgatgacctcagggacgctgaagacatacctgaagcggttcaaggtgatgaagcccaaggttctccgcagctggtgccggcagatcctgaagggcctgctgttcctgcacacaaggacgccacccatcatccaccgagacctgaaatgtgacaatattttcatcaccggaccaactgggtctgtgaagattggcgacttgggcctggccactctgaaaagagcgtcatttgccaaaagtgtgataggtactcccgagttcatggcgcccgagatgtacgaggagcactacgatgagtccgtggacgtctatgcctttgggatgtgcatgctggagatggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaaggcttcgaacatcagtcagtgaaggaccctgcaagactgaaaaaaagtcactacagttatctcagcctactgccttgaaaaagtttctattccagagcagggaaggaagagcccaggcagagcttgggagattgtggagtgaggagaccaagctgagagtgtggagagacccaaatgtcaagaatttccaaggcggagttctggagaggagagagctgcggagagaagagtctgaagataacgggtgattcccctggatgatttcgcagagcactgtgtgtgaggaaactcacccaggctgaggaatgacccaccacgaaggatcagagggagtggacccgggaactcacacaggcctgggaatgtctgttcctgccagccagctggaaagccttataattcaaggggttttgggtacagtacaaaaaaggcgcttgcctcagtcctggaggataattagccctagactaagtgcttctcttacctcacctgtcagatcttaagagcaggatctgagaagatccaattgtttcaaggtaacttaactgcatcccacaacacacttcaagaatgtttataggaatacaaattcatccagcacccaatatgttaaattttacattatctggcatccaatccaaattatgagaca

SEQ ID NO: 5708 - DNA, 4671 bp, Artificial Sequence
  Synthetic polypeptide
gcggccgccgagacgtccccggcacgctgatggagcccgggcgcggcgcggggcccgcgggcatggcggagcctcgggcgaaggcggcgcggccggggccccagcgctttctgcggcgcagcgtggtagagtcggaccaggaggagccgccgggcttggaggcagccgaggcgccgggcccgcagcccccgcagcccctgcagcgccgggtgcttctgctctgcaagacgcgccgcctcatcgcggagcgcgcccgcggacgccccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggaccggaagctcaccaagctggagcggcagcggttcaaggaagaggctgagatgctgaaaggcctgcagcaccccaacatcgtgcgcttctacgacttctgggagtccagcgccaagggcaagcggtgcattgtgctggtgacggagctgatgacctcagggacgctgaagacatacctgaagcggttcaaggtgatgaagcccaaggttctccgcagctggtgccggcagatcctgaagggcctgctgttcctgcacacaaggacgccacccatcatccaccgagacctgaaatgtgacaatattttcatcaccggaccaactgggtctgtgaagattggcgacttgggcctggccactctgaaaagagcgtcatttgccaaaagtgtgataggtactcccgagttcatggcgcccgagatgtacgaggagcactacgatgagtccgtggacgtctatgcctttgggatgtgcatgctggagatggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaaggcttcgaacatcagtcagtgaaggaccctgcaagactgaaaaaaagtcactacagttatctcagcctactgccttgaaaaagtttctattccagagcagggaaggaagagcccaggcagagcttgggagattgtggagtgaggagaccaagctgagagtgtggagagacccaaatgtcaagaatttccaaggcggagttctggagaggagagagctgcggagagaagagtctgaagataacgggtgattcccctggatgatttcgcagagcactgtgtgtgaggaaactcacccaggctgaggaatgacccaccacgaaggatcagagggagtggacccgggaactcacacaggcctgggaatgtctgttcctgccagccagctggaaagccttataattcaaggggttttgggtacagtacaaaaaaggcgcttgcctcagtcctggaggataattagccctagactaagtgcttctcttacctcacctgtcagatcttaagagcaggatctgagaagatccaattgtttcaaggtaacttaactgcatcccacaacacacttcaagaatgtttataggaatacaaattcatccagcacccaatatgttaaattttacattatctggcatccaatccaaattatgagaca

SEQ ID NO: 5709 - DNA, 3494 bp, Artificial Sequence
  Synthetic polypeptide
ggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaaggcttcgaacatcagtcagtgaaggaccctgcaagactgaaaaaaagtcactacagttatctcagcctactgccttgaaaaagtttctattccagagcagggaaggaagagcccaggcagagcttgggagattgtggagtgaggagaccaagctgagagtgtggagagacccaaatgtcaagaatttccaaggcggagttctggagaggagagagctgcggagagaagagtctgaagataacgggtgattcccctggatgatttcgcagagcactgtgtgtgaggaaactcacccaggctgaggaatgacccaccacgaaggatcagagggagtggacccgggaactcacacaggcctgggaatgtctgttcctgccagccagctggaaagccttataattcaaggggttttgggtacagtacaaaaaaggcgcttgcctcagtcctggaggataattagccctagactaagtgcttctcttacctcacctgtcagatcttaagagcaggatctgagaagatccaattgtttcaaggtaacttaactgcatcccacaacacacttcaagaatgtttataggaatacaaattcatccagcacccaatatgttaaattttacattatctggcatccaatccaaattatgagaca

SEQ ID NO: 5710 - DNA, 1074 bp, Artificial Sequence
  Synthetic polypeptide
gccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaaggcttcgaacatcagtcagtgaaggaccctgcaagactgaaaaaaagtcactacagttatctcagcctactgccttgaaaaagtttctattccagagcagggaaggaagagcccaggcagagcttgggagattgtggagtgaggagaccaagctgagagtgtggagagacccaaatgtcaagaatttccaaggcggagttctggagaggagagagctgcggagagaagagtctgaagataacgggtgattcccctggatgatttcgcagagcactgtgtgtgaggaaactcacccaggctgaggaatgacccaccacgaaggatcagagggagtggacccgggaactcacacaggcctgggaatgtctgttcctgccagccagctggaaagccttataattcaaggggttttgggtacagtacaaaaaaggcgcttgcctcagtcctggaggataattagccctagactaagtgcttctcttacctcacctgtcagatcttaagagcaggatctgagaagatccaattgtttcaaggtaacttaactgcatcccacaacacacttcaagaatgtttataggaatacaaattcatccagcacccaatatgttaaattttacattatctggcatccaatccaaattatgagaca

SEQ ID NO: 5711 - DNA, 729 bp, Artificial Sequence
  Synthetic polypeptide
atggccggcctccgagggaacgctgtggctggcctcctctggatgctgctgctgtggagtgggggcggcggctgccaggctcagcgggcaggttgcaaaagtgtccactacgatctggtcttcctcctggacacctcctccagcgtgggcaaggaggactttgagaaggtccggcagtgggtggccaacctggtggacaccttcgaggtgggccccgaccgcacccgtgtgggggtcgtgcgctacagcgaccggcccaccacggccttcgagttgggactctttggctcgcaggaggaggtcaaggcggctgcccggcgtctcgcctaccacgggggcaacaccaacacgggagacgcgctccgctacatcacggcccgcagcttctccccacacgccggcggccgccccagggaccgcgcctacaagcaggtggccatcctgctcaccgacggccgcagccaggacctggtgctggacgccgcggcggcagcccaccgcgctggcatccgcatctttgccgtgggcgtgggcgaggcactcaaggaggagctggaggagatcgcctcagagcccaagtccgcccacgtcttccacgtgtccgacttcaatgccatcgacaagatccggggcaagctgcggcgccgtctttgtgaaacatctgtgaaatgggtagaacaagcccacctatgactgtgaagattcaatgcattaatacaggaaaagtgc

SEQ ID NO: 5712 - DNA, 55 bp, Artificial Sequence; identical to SEQ ID NO: 291
  Synthetic polypeptide

SEQ ID NO: 5713 - DNA, 25 bp, Artificial Sequence
  Synthetic polypeptide
atgagcgtcctttcgtttttttaaa

SEQ ID NO: 5714 - DNA, 2161 bp, Artificial Sequence; identical to SEQ ID NO: 288
  Synthetic polypeptide

SEQ ID NO: 5715 - DNA, 2140 bp, Artificial Sequence; identical to SEQ ID NO: 289
  Synthetic polypeptide

SEQ ID NO: 5716 - DNA, 529 bp, Artificial Sequence; identical to SEQ ID NO: 287
  Synthetic polypeptide

SEQ ID NO: 5717 - DNA, 4119 bp, Artificial Sequence; identical to SEQ ID NO: 4714
  Synthetic polypeptide

SEQ ID NO: 5718 - DNA, 4059 bp, Artificial Sequence; identical to SEQ ID NO: 4715
  Synthetic polypeptide

SEQ ID NO: 5719 - DNA, 817 bp, Artificial Sequence; identical to SEQ ID NO: 1990
  Synthetic polypeptide

SEQ ID NO: 5720 - DNA, 603 bp, Artificial Sequence; identical to SEQ ID NO: 1012
  Synthetic polypeptide

SEQ ID NO: 5721 - DNA, 270 bp, Artificial Sequence; identical to SEQ ID NO: 5331
  Synthetic polypeptide

SEQ ID NO: 5722 - DNA, 255 bp, Artificial Sequence; identical to SEQ ID NO: 5332
  Synthetic polypeptide

SEQ ID NO: 5723 - DNA, 336 bp, Artificial Sequence; identical to SEQ ID NO: 5333
  Synthetic polypeptide

SEQ ID NO: 5724 - DNA, 157 bp, Artificial Sequence; identical to SEQ ID NO: 1500
  Synthetic polypeptide

SEQ ID NO: 5725 - DNA, 1490 bp, Artificial Sequence; identical to SEQ ID NO: 1677
  Synthetic polypeptide

SEQ ID NO: 5726 - DNA, 1451 bp, Artificial Sequence; identical to SEQ ID NO: 1678
  Synthetic polypeptide

SEQ ID NO: 5727 - DNA, 926 bp, Artificial Sequence; identical to SEQ ID NO: 1679
  Synthetic polypeptide

SEQ ID NO: 5728 - DNA, 1451 bp, Artificial Sequence; identical to SEQ ID NO: 1680
  Synthetic polypeptide

SEQ ID NO: 5729 - DNA, 1039 bp, Artificial Sequence
  Synthetic polypeptide
atgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtagaaaccactcagcaatgaaaaggaagaaacca

SEQ ID NO: 5730 - DNA, 346 bp, Artificial Sequence
  Synthetic polypeptide
atgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtagaaaccactcagcaatgaaaaggaagaaacca

SEQ ID NO: 5731 - DNA, 575 bp, Artificial Sequence; identical to SEQ ID NO: 2296
  Synthetic polypeptide

SEQ ID NO: 5732 - DNA, 582 bp, Artificial Sequence; identical to SEQ ID NO: 1259
  Synthetic polypeptide

SEQ ID NO: 5733 - DNA, 1215 bp, Artificial Sequence; identical to SEQ ID NO: 1260
  Synthetic polypeptide

SEQ ID NO: 5734 - DNA, 705 bp, Artificial Sequence; identical to SEQ ID NO: 1261
  Synthetic polypeptide

SEQ ID NO: 5735 - DNA, 393 bp, Artificial Sequence; identical to SEQ ID NO: 1400
  Synthetic polypeptide

SEQ ID NO: 5736 - DNA, 272 bp, Artificial Sequence; identical to SEQ ID NO: 1401
  Synthetic polypeptide

SEQ ID NO: 5737 - DNA, 175 bp, Artificial Sequence
  Synthetic polypeptide
atggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggcttacatgg

SEQ ID NO: 5738 - DNA, 1640 bp, Artificial Sequence; identical to SEQ ID NO: 2480
  Synthetic polypeptide

SEQ ID NO: 5739 - DNA, 1435 bp, Artificial Sequence; identical to SEQ ID NO: 2481
  Synthetic polypeptide

SEQ ID NO: 5740 - DNA, 1628 bp, Artificial Sequence; identical to SEQ ID NO: 2482
  Synthetic polypeptide

SEQ ID NO: 5741 - DNA, 2848 bp, Artificial Sequence; identical to SEQ ID NO: 3654
  Synthetic polypeptide

SEQ ID NO: 5742 - DNA, 181 bp, Artificial Sequence; identical to SEQ ID NO: 5321
  Synthetic polypeptide

SEQ ID NO: 5743 - DNA, 578 bp, Artificial Sequence; identical to SEQ ID NO: 1946
  Synthetic polypeptide

SEQ ID NO: 5744 - DNA, 488 bp, Artificial Sequence; identical to SEQ ID NO: 1947
  Synthetic polypeptide

SEQ ID NO: 5745 - DNA, 479 bp, Artificial Sequence; identical to SEQ ID NO: 1948
  Synthetic polypeptide

SEQ ID NO: 5746 - DNA, 470 bp, Artificial Sequence; identical to SEQ ID NO: 1949
  Synthetic polypeptide

SEQ ID NO: 5747 - DNA, 576 bp, Artificial Sequence
  Synthetic polypeptide
atgggggctaaccagttagtggtgctcaacgtgtacgacatgtattggatgaacgaatatacctcatccattggaattggagtttttcattcaggaattgaagtctatggcagagaatttgcttatggtggccatccttaccccttttctggaatatttgaaatttccccaggaaatgcttctgaactaggagaaacatttaaatttaaagaagctgttgttttagggagcacggacttcctagaagatgatatagaaaaaattgtagaagaactgggaaaagaatacaaaggcaatgcttatcatttaatgcataaaaactgcaatcatttttcttcagctttatcagagatgctgcaagcactttgaattcaaacagcctgctgagcctgtgctcaaacctatgagagcagggagtggcctcagctcctgcacttcccacacggaacacctccagatgtcatccacagtcgtgaggctgataacctgatgtcatggaccaacatggaactgactgtcttcaggtagtccctctgaaacaaaaactcaaactaagttttcaggctggagtggaaa

SEQ ID NO: 5748 - DNA, 477 bp, Artificial Sequence
  Synthetic polypeptide
atgggggctaaccagttagtggtgctcaacgtgtacgacatgtattggatgaacgaatatacctcatccattggaattggagtttttcattcaggaattgaagtctatggcagagctgttgttttagggagcacggacttcctagaagatgatatagaaaaaattgtagaagaactgggaaaagaatacaaaggcaatgcttatcatttaatgcataaaaactgcaatcatttttcttcagctttatcagagatgctgcaagcactttgaattcaaacagcctgctgagcctgtgctcaaacctatgagagcagggagtggcctcagctcctgcacttcccacacggaacacctccagatgtcatccacagtcgtgaggctgataacctgatgtcatggaccaacatggaactgactgtcttcaggtagtccctctgaaacaaaaactcaaactaagttttcaggctggagtggaaa

SEQ ID NO: 5749 - DNA, 1178 bp, Artificial Sequence; identical to SEQ ID NO: 1256
  Synthetic polypeptide

SEQ ID NO: 5750 - DNA, 947 bp, Artificial Sequence; identical to SEQ ID NO: 1257
  Synthetic polypeptide

SEQ ID NO: 5751 - DNA, 857 bp, Artificial Sequence; identical to SEQ ID NO: 1258
  Synthetic polypeptide

SEQ ID NO: 5752 - DNA, 285 bp, Artificial Sequence; identical to SEQ ID NO: 4104
  Synthetic polypeptide

SEQ ID NO: 5753 - DNA, 370 bp, Artificial Sequence; identical to SEQ ID NO: 4105
  Synthetic polypeptide

SEQ ID NO: 5754 - DNA, 250 bp, Artificial Sequence; identical to SEQ ID NO: 4106
  Synthetic polypeptide

SEQ ID NO: 5755 - DNA, 400 bp, Artificial Sequence; identical to SEQ ID NO: 4107
  Synthetic polypeptide

SEQ ID NO: 5756 - DNA, 403 bp, Artificial Sequence; identical to SEQ ID NO: 4108
  Synthetic polypeptide

SEQ ID NO: 5757 - DNA, 1445 bp, Artificial Sequence
  Synthetic polypeptide
atggcggcgcccaggccgccgcctgccaggctgtcgggcgtcatggtgccggcgcccatccaagacctggaggccctgcgcgcgctcacggcgctcttcaaagagcagcggaaccggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgtttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggaacaaggcaagaatttctgctctcaccactccagtaaacaacgtgctgaaggtccagagcaactcactaagccaagaaaaatcagatgcatgcaggttggaaagaagtaaaactggctttattcataaatgaggtgatcgtgtgtgttaaggaactgataaagttatgagaagtgaattttgaatggttacaagatatgtaaatgaaaattaattatataaaactagcaaataataataagaaaaaatttaaatgccacatacaatagcatcataaaacatgaaatatttaggaataaactttaacgaaatatgtgcaagacctatactctgaaaaccataaaacattgctgagagaagttaaaatttaacagacagctcaatattgttaagtgttagatctccccaagttgacctctatagagtgaatgctataccagtcagaatgccaggagacatttgtg

SEQ ID NO: 5758 - DNA, 1637 bp, Artificial Sequence
  Synthetic polypeptide
atggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgtttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggaacaaggcaagaatttctgctctcaccactccagtaaacaacgtgctgaaggtccagagcaactcactaagccaagaaaaatcagatgcatgcaggttggaaagaagtaaaactggctttattcataaatgaggtgatcgtgtgtgttaaggaactgataaagttatgagaagtgaattttgaatggttacaagatatgtaaatgaaaattaattatataaaactagcaaataataataagaaaaaatttaaatgccacatacaatagcatcataaaacatgaaatatttaggaataaactttaacgaaatatgtgcaagacctatactctgaaaaccataaaacattgctgagagaagttaaaatttaacagacagctcaatattgttaagtgttagatctccccaagttgacctctatagagtgaatgctataccagtcagaatgccaggagacatttgtg

SEQ ID NO: 5759 - DNA, 893 bp, Artificial Sequence
  Synthetic polypeptide
cttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggaacaaggcaagaatttctgctctcaccactccagtaaacaacgtgctgaaggtccagagcaactcactaagccaagaaaaatcagatgcatgcaggttggaaagaagtaaaactggctttattcataaatgaggtgatcgtgtgtgttaaggaactgataaagttatgagaagtgaattttgaatggttacaagatatgtaaatgaaaattaattatataaaactagcaaataataataagaaaaaatttaaatgccacatacaatagcatcataaaacatgaaatatttaggaataaactttaacgaaatatgtgcaagacctatactctgaaaaccataaaacattgctgagagaagttaaaatttaacagacagctcaatattgttaagtgttagatctccccaagttgacctctatagagtgaatgctataccagtcagaatgccaggagacatttgtg

SEQ ID NO: 5760 - DNA, 735 bp, Artificial Sequence
  Synthetic polypeptide
ggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggaacaaggcaagaatttctgctctcaccactccagtaaacaacgtgctgaaggtccagagcaactcactaagccaagaaaaatcagatgcatgcaggttggaaagaagtaaaactggctttattcataaatgaggtgatcgtgtgtgttaaggaactgataaagttatgagaagtgaattttgaatggttacaagatatgtaaatgaaaattaattatataaaactagcaaataataataagaaaaaatttaaatgccacatacaatagcatcataaaacatgaaatatttaggaataaactttaacgaaatatgtgcaagacctatactctgaaaaccataaaacattgctgagagaagttaaaatttaacagacagctcaatattgttaagtgttagatctccccaagttgacctctatagagtgaatgctataccagtcagaatgccaggagacatttgtg

SEQ ID NO: 5761 - DNA, 454 bp, Artificial Sequence; identical to SEQ ID NO: 2297
  Synthetic polypeptide

SEQ ID NO: 5762 - DNA, 412 bp, Artificial Sequence; identical to SEQ ID NO: 1704
  Synthetic polypeptide

SEQ ID NO: 5763 - DNA, 1213 bp, Artificial Sequence; identical to SEQ ID NO: 1093
  Synthetic polypeptide

SEQ ID NO: 5764 - DNA, 616 bp, Artificial Sequence; identical to SEQ ID NO: 1094
  Synthetic polypeptide

SEQ ID NO: 5765 - DNA, 868 bp, Artificial Sequence; identical to SEQ ID NO: 1095
  Synthetic polypeptide

SEQ ID NO: 5766 - DNA, 581 bp, Artificial Sequence; identical to SEQ ID NO: 4675
  Synthetic polypeptide

SEQ ID NO: 5767 - DNA, 384 bp, Artificial Sequence
  Synthetic polypeptide
atggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatt

SEQ ID NO: 5768 - DNA, 27 bp, Artificial Sequence
  Synthetic polypeptide
atgatatgggagtataatgttgtgatt

SEQ ID NO: 5769 - DNA, 272 bp, Artificial Sequence
  Synthetic polypeptide
tgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatt

SEQ ID NO: 5770 - DNA, 910 bp, Artificial Sequence
  Synthetic polypeptide
atgctctcgggcatagaggcggcggcaggggaatatgaggactcggagctgcggtgccgcgtggctgtggaggagctgagcccgggcgggcagccgcgaaggcgccaggccctgcgcaccgcggagctgagcctgggtcgcaacgagcgccgcgagttgatgctgcggctgcaagcgccagggcccgcggggcggccgcgctgctttcctctgcgcgccgcgcgcctcttcacgcgtttcgccgaggccgggcgcagcaccctgcggctccccgcccacgacacccccggggccggcgcagtgcagctgctgctctcggactgccccccagaccgcctgcgccgcttcctgcgcacattgcgcctcaagctggctgcggccccgggtcccgggccggcctccgcccgagcgcagctgctgggcccgcggccccgcgacttcgtcaccatcagccctgtgcagcccgaggagcggcggctcagggcggccacccgggttccggacactacgctggtgaagcggcctgtggagccccaggctggggccgagcctagcacagaagccccaaggtggcccctgcctgtgaagaggctgagcttgccctccaccaagccacagctttctgaggaacaggctgctgtgctgagggccgtcctgaaaggccagagcatcttcttcactgggagtgcaggaacagggaagtcatatctgctaaagcgaatcctgggctcactgccccccacaggcactgtggccactgccagcactggggtggcagcctgccacatcgggggcaccaccctccatgcctttgcaggaggccaaggtgggaggatcgcttgagcccaggagtttgagaccagcctggccaacacagtaaaccctgtctccacaaaatttaaaaattagc

SEQ ID NO: 5771 - DNA, 247 bp, Artificial Sequence
  Synthetic polypeptide
atgtatggggtctttgtgcggattctgactgagcgttcacagaggaaggcgttcctgcaggcccggagctgcattgaggaccgactgaggctggaggatgagaacgagaagcaggagcggctcctcatgagcctcctgccccggaacgttgccatggagatgaaggaggacttcctgaagccccctgagaggattttccacaagatttacatccagaggcacgacaatgtgaggagagaaagggttg

SEQ ID NO: 5772 - DNA, 922 bp, Artificial Sequence
  Synthetic polypeptide
atggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgcgcccggcctggccaagggctcacacccggtgcactgcgtcctcttcctggcgctgctcgtggtaaccaacgtccggtccctgcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtcacagccaccttggtccccgccaagcgcccacgtctctggaggacgctcggtgccaatgccttgctcttcgtcggtgtgaacatgtatggggtctttgtgcggattctgactgagcgttcacagaggaaggcgttcctgcaggcccggagctgcattgaggaccgactgaggctggaggatgagaacgagaagcaggagcggctcctcatgagcctcctgccccggaacgttgccatggagatgaaggaggacttcctgaagccccctgagaggattttccacaagatttacatccagaggcacgacaatgtgaggagagaaagggttg

SEQ ID NO: 5773 - DNA, 2138 bp, Artificial Sequence; identical to SEQ ID NO: 1775
  Synthetic polypeptide

SEQ ID NO: 5774 - DNA, 688 bp, Artificial Sequence; identical to SEQ ID NO: 1776
  Synthetic polypeptide

SEQ ID NO: 5775 - DNA, 625 bp, Artificial Sequence; identical to SEQ ID NO: 1777
  Synthetic polypeptide

SEQ ID NO: 5776 - DNA, 1655 bp, Artificial Sequence; identical to SEQ ID NO: 2605
  Synthetic polypeptide

SEQ ID NO: 5777 - DNA, 2153 bp, Artificial Sequence; identical to SEQ ID NO: 217
  Synthetic polypeptide

SEQ ID NO: 5778 - DNA, 1664 bp, Artificial Sequence; identical to SEQ ID NO: 222
  Synthetic polypeptide

SEQ ID NO: 5779 - DNA, 1766 bp, Artificial Sequence; identical to SEQ ID NO: 221
  Synthetic polypeptide

SEQ ID NO: 5780 - DNA, 1736 bp, Artificial Sequence; identical to SEQ ID NO: 156
  Synthetic polypeptide

SEQ ID NO: 5781 - DNA, 1724 bp, Artificial Sequence; identical to SEQ ID NO: 157
  Synthetic polypeptide

SEQ ID NO: 5782 - DNA, 632 bp, Artificial Sequence; identical to SEQ ID NO: 4501
  Synthetic polypeptide

SEQ ID NO: 5783 - DNA, 1747 bp, Artificial Sequence; identical to SEQ ID NO: 1612
  Synthetic polypeptide

SEQ ID NO: 5784 - DNA, 1762 bp, Artificial Sequence; identical to SEQ ID NO: 1613
  Synthetic polypeptide

SEQ ID NO: 5785 - DNA, 624 bp, Artificial Sequence; identical to SEQ ID NO: 1614
  Synthetic polypeptide

SEQ ID NO: 5786 - DNA, 1893 bp, Artificial Sequence; identical to SEQ ID NO: 5559
  Synthetic polypeptide

SEQ ID NO: 5787 - DNA, 57 bp, Artificial Sequence
  Synthetic polypeptide
atggctcttcctcagcaccactgggttagggtctccctgactgagctggtctcggca

SEQ ID NO: 5788 - DNA, 57 bp, Artificial Sequence; identical to SEQ ID NO: 5787
  Synthetic polypeptide

SEQ ID NO: 5789 - DNA, 1329 bp, Artificial Sequence
  Synthetic polypeptide
atggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactatcagggaaaagacttgaacatcagcatctcatactgaacctttcaatagaggctcttaccattgtagtaaaaaggagaataaataaaaagcataagaactgaaaaaggaaaataaaaagctgccaaattgcctctatgtgtggctgatttatgttctgcattgtggatgatattgtgttctgtactgtaaaaccaaaaaaaattatttcaattaataagagtttagcagtgatgctgaataaaccagtaacaatcagaaattataatttttacatttaatttacaatggcaaatatatgtaaaattatatcagagaaaatgtgcaaatcttttataaaaaagattattaaaatgaatttaagagatgttaaatgaaaagtatactatatttttgatatgaaaagtcattataaatgtagtaaaaatgttgattgtcctcaaattgatctgtgaattaaatacaatttcattcaaaatttgaacaggtattttgttgaactttaaaaactgattctaaaattaacatgaaaaagcaagaattcgagaagactccatccattcctaaagaagcatggatagacaggataacatcattgtaattatacaatgtgatgttagtagaaggaaagataaatagagcaatagagagacaagaaacaaa

SEQ ID NO: 5790 - DNA, 945 bp, Artificial Sequence
  Synthetic polypeptide
atgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactatcagggaaaagacttgaacatcagcatctcatactgaacctttcaatagaggctcttaccattgtagtaaaaaggagaataaataaaaagcataagaactgaaaaaggaaaataaaaagctgccaaattgcctctatgtgtggctgatttatgttctgcattgtggatgatattgtgttctgtactgtaaaaccaaaaaaaattatttcaattaataagagtttagcagtgatgctgaataaaccagtaacaatcagaaattataatttttacatttaatttacaatggcaaatatatgtaaaattatatcagagaaaatgtgcaaatcttttataaaaaagattattaaaatgaatttaagagatgttaaatgaaaagtatactatatttttgatatgaaaagtcattataaatgtagtaaaaatgttgattgtcctcaaattgatctgtgaattaaatacaatttcattcaaaatttgaacaggtattttgttgaactttaaaaactgattctaaaattaacatgaaaaagcaagaattcgagaagactccatccattcctaaagaagcatggatagacaggataacatcattgtaattatacaatgtgatgttagtagaaggaaagataaatagagcaatagagagacaagaaacaaa

SEQ ID NO: 5791 - DNA, 2696 bp, Artificial Sequence
  Synthetic polypeptide
atgaaaatgaaaatacagaaaaaagagaagcagttgtcaaatttaaaagttttgaatcactccccaatgtctgatgcctctgtcaattttgactacaaatctccatccccatttgactgcagcactgatcaagaagagaaaattgaagatgttgctagtcactgtctgcctcagaaggacctgtatactgctgaagaggaagctgctaccctttttcctaggaaaatgacatcccataatgggatggaggacagtggaggaggaggtactggagtgaagaagaaacggaagaaaaaggagccaggagaccaagagggtgcagcaaagggaagcaaggacagagagcccaagccaaagaggaaacgagaaccgaaagagccaaaggaacccagaaaggccaaggagccgaagaaggccaaggagcacaaggagccgaagcaaaaagatggggcaaagaaggcacggaagccccgggaggcctcgggcaccaaggaggccaaagagaagaggagctgcactgactctgcagccaggacgaagtccaggaaggccagcaaggagcaaggaccaaccccagtggagaaaaagaagaaaggaaaaaggaaaagtgaaactacagtggagagtttagagctggatcagggcctgacgaacccatctctgcggagtcctgaggagtccactgagtctacagacagccagaaacgacgctcgggaaggcaagtaaagcgcagaaaatacaatgaggacctggacttcaaagtggtggatgatgatggggaaacaattgctgttcttggagctggtcgaacatctgcactctcagcctctacactggcctggcaggcggaggagcctccagaagatgatgcaaacatcattgagaagatcctggcatctaagactgtccaggaggttcacccaggagaacctccgttcgacttggagctgttctacgttaagtatagaaatttttcctacttacattgtaaatgggccacaatggaagagctcgaaaaggatcctcgcatcgcacagaagatcaagcgatttaggaataaacaagcccagatgaagcacatttttacggagcctgatgaagacttgttcaatccagactatgtagaagttgatcgcatcttggaggtggcccacaccaaggatgcagaaacaggggaggaggtaacacattacctggtgaagtggtgctcactaccatatgaagaaagcacgtgggagctagaggaagatgtagatcctgcaaaagttaaagaatttgaatctcttcaagttctccctgaaattaagcatgtggagcggcctgcttcagactcctggcagaaacttgagaagtctcgcgagtataagaacagtaaccagctccgggagtaccagctggaagggatgaactggcttctttttaactggtataacagaaaaaactgtattttggctgatgagatgggcctagggaaaaccatccagtccatcacattcctttcagaaatatttctgagaggaatccacggcccttttctcattatcgcccctctctccaccatcactaactgggagcgggagttccggacatggacagagatgaatgccattgtgtaccacggcagccagatcagcaggcagatgatccagcagtatgaaatggtgtacagagacgcccagggaaaccccctttcaggagtcttcaagttccacgtcgtcatcacaacatttgaaatgatcctagcagactgcccagagttgaagaagattcactggagctgtgtgataattgatgaagcccacagactgaagaataggaactgcaaacttctggagggtctaaagcttatggccctggaacataaagtgcttctcactggaacacccttgcagaactctgtggaggagctcttcagtttgttaaattttctggagccatcacagtttccttcagagaccgctttcttggaggaatttggagatctgaaaacagaggagcaggtaaagaaactgcagtctatcctaaaaccaatgatgcttcggcggctgaaagatgatgtggaaaagaaccttgctcccaaacaagagacgatcattgaggtggaactgaccaatatccagaaaaagtactaccgtgccatcctcgagaagaacttttccttcctgaccaagggggcaaatcagcacaacatgcccaatctcatcaacaccatgatggagctgaggaagtgctgtaaccatccctacctgatcaatggagcagaggagaaaattctagaagatttccgaaaaacccacagccctgatgcccctgactttcagctgcaggccatgattcaggcagcaggaaagcttgtgttgattgataaactactccctaagctgattgcaggtggccacaaagtactcatcttctcccagatggtgcgctgcctcgacatcctagaagattacctcatccagagaagatacacctatgagcgaattgatgggcgagtacggggaaacctgcgccaggcagccatcgaccggttctgtaagccagattcagaccgctttgtctttcttctgtgcaccagagcgggaggcctggggatcaatctcacagctgctgatacctgcatcatatttgattctgactggaacccacaaaatgacttgcaggtgattgatcaaaagaagtttggaggctgctg

SEQ ID NO: 5792 - DNA, 756 bp, Artificial Sequence; identical to SEQ ID NO: 1387
  Synthetic polypeptide

SEQ ID NO: 5793 - DNA, 1389 bp, Artificial Sequence; identical to SEQ ID NO: 1388
  Synthetic polypeptide

SEQ ID NO: 5794 - DNA, 582 bp, Artificial Sequence; identical to SEQ ID NO: 4738
  Synthetic polypeptide

SEQ ID NO: 5795 - DNA, 546 bp, Artificial Sequence; identical to SEQ ID NO: 4739
  Synthetic polypeptide

SEQ ID NO: 5796 - DNA, 567 bp, Artificial Sequence; identical to SEQ ID NO: 4740
  Synthetic polypeptide

SEQ ID NO: 5797 - DNA, 552 bp, Artificial Sequence; identical to SEQ ID NO: 4741
  Synthetic polypeptide

SEQ ID NO: 5798 - DNA, 597 bp, Artificial Sequence; identical to SEQ ID NO: 4742
  Synthetic polypeptide

SEQ ID NO: 5799 - DNA, 1137 bp, Artificial Sequence
  Synthetic polypeptide
atggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgtaaggtgcgcagcagaaagcatttaaccagcatggctacttcatattttggaaagcagtttttaagacaattttcaacaacaacaaaagatgtgaagaaacagcaattacagccgcctatatatgggggaaaaaacttagaaaacagaaaccatccctgagaaaacccagacattagatctattaaacaaaaagtttgtcaacctttaaatatgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacagtcgttaaagcagcaggagaaaaacaacttatcacatacaagggatcctgtgtaagattaaatgcctaccactcatcagaaactacagaggtcagaaggctgtagaatgacatattcaaagtgctaaaagaaaaaaacttaacagagaattttagatccagcaaaactatccttcaaaactataagaaaggat

SEQ ID NO: 5800 - DNA, 1203 bp, Artificial Sequence
  Synthetic polypeptide
atggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgtaaggtgcgcagcagaaagcatttaaccagcatggctacttcatattttggaaagcagtttttaagacaattttcaacaacaacaaaagatgtgaagaaacagcaattacagccgcctatatatgggggaaaaaacttagaaaacagaaaccatccctgagaaaacccagacattagatctattaaacaaaaagtttgtcaacctttaaatatgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacagtcgttaaagcagcaggagaaaaacaacttatcacatacaagggatcctgtgtaagattaaatgcctaccactcatcagaaactacagaggtcagaaggctgtagaatgacatattcaaagtgctaaaagaaaaaaacttaacagagaattttagatccagcaaaactatccttcaaaactataagaaaggat

SEQ ID NO: 5801 - DNA, 1395 bp, Artificial Sequence
  Synthetic polypeptide
atgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctgtgagttgctcagcagcagctttattacctgtatggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgtaaggtgcgcagcagaaagcatttaaccagcatggctacttcatattttggaaagcagtttttaagacaattttcaacaacaacaaaagatgtgaagaaacagcaattacagccgcctatatatgggggaaaaaacttagaaaacagaaaccatccctgagaaaacccagacattagatctattaaacaaaaagtttgtcaacctttaaatatgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacagtcgttaaagcagcaggagaaaaacaacttatcacatacaagggatcctgtgtaagattaaatgcctaccactcatcagaaactacagaggtcagaaggctgtagaatgacatattcaaagtgctaaaagaaaaaaacttaacagagaattttagatccagcaaaactatccttcaaaactataagaaaggat

SEQ ID NO: 5802 - DNA, 763 bp, Artificial Sequence; identical to SEQ ID NO: 261
  Synthetic polypeptide

SEQ ID NO: 5803 - DNA, 646 bp, Artificial Sequence; identical to SEQ ID NO: 262
  Synthetic polypeptide

SEQ ID NO: 5804 - DNA, 303 bp, Artificial Sequence; identical to SEQ ID NO: 148
  Synthetic polypeptide

SEQ ID NO: 5805 - DNA, 301 bp, Artificial Sequence; identical to SEQ ID NO: 147
  Synthetic polypeptide

SEQ ID NO: 5806 - DNA, 593 bp, Artificial Sequence
  Synthetic polypeptide
atgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacgtatatgcccagatggcctgaagtaactgaagaatcacaaaagaagtgaatgtgccctgccccgccttaactgatgacattccaccacaaaagaagtgtaaatggccggtccttgccttaagtgatgacattaccttgtgaaagtccttttcctgactcatccggggtcaaaaagctcccccactgagcaccttgcgactcccattcctgcccaccagagaacgaaccccctttgactgtaattttcctttacctgcccaaatcttataaaacggccccacccttatctccctttgctgactctcttttcggactcagcccgcctgcacccaggtgattaaaagcttttattgctcacacaagcctgtttggtggtcccttcacacggacgcgcatga

SEQ ID NO: 5807 - DNA, 1465 bp, Artificial Sequence
  Synthetic polypeptide
atgttgctgttcctgtggatagaaacatccagtgaatactttaactttgactgggtcacttttctaggaacaggatactggtttttctggtctatttttattctgagtttagctaggatcctgactgcctactcttcattgctgttgttacttggatttttgttgctttgggaaaggattgaactatacctgcacttgtgtcataagatcctgattctgctagtgattcttctgtgtgtcattttaatgttcattatatgcaaattctggaaagaaaggtggctggtagctgggctgtcaatgcagatctttgctccctacgtgcacctggtcagcataactgtgatggttatccttttctggcctgtggccttctacgtggcatgtttggaaagagaagttagaatgagaagatacaggatgacacattctgagaaaaaaagactcaagcaatgtaatgtaatcacaaggttaagaggtctacaagtgcctgttggattaccctttcttcttatccttttaggtctctatttgatgccactggggatttattctccctgcattcaggagaaggagaatttggggcccaagccaaccatctttggacatagaggtgcacccatgttggggcctgagaataccatgatgtcctttgagaaagctgttgaacatggagcccatggattggagactgatatacacttaagttatgatcatgtgcctttcctcatgcatgactttgacctgaaaagaacaaccaatattggggaagttcagccagaatctgcctgcgagaaccctgccttcttcaactgggatttcctatcgactctgaatgcaggcaaatggtttgtaaaaccagagctcaggccattttacaatatgaaacctctatcagaggcagataaagaaagagcaagaaatcagtcaattccaacactagctgatttattgacacttgcagagaaggaaagaaaatttgtgatatttgatcttcatcgccctccaccaaaacatcctctcagacacacatttgtccgccaagtagtaagcgtgatccttgcctctaaaatcgagcaacatctgattttttggttgccagctcatgataggcaatacgtcaggtccgtggctcctggttttcagcatgtgggccgtttagtatccattgaaacccttgctaaaaacaatatcagtataataaatgttgactacaagaagttgttccctaatgggttaagagattataaagcagctaacatccatatcaacgtatacaccgtcaatgagccttggcttttctcactggcctggtgctccaggattaactcagtgaccacagacaacattgggctcctgagtcagcttgatcaccctcacttcttcatggtgtctagtgagacccagaaacctgtattactaaaagctgccccgggagacttggctgcacagccaggtttgagaa

SEQ ID NO: 5808 - DNA, 722 bp, Artificial Sequence
  Synthetic polypeptide
atggcgcctcccgtccgtctcgagcgtccctttccttcccggcgctttcctgggttgcttctggcggccctggtgttgctgctgtcctccttctccgatcaatgcaatgtcccggaatggcttccatttgccaggcctaccaacctaactgatgactttgagtttcccattgggacatatctgaactatgaatgccgccctggttattccggaagaccgttttctatcatctgcctaaaaaactcagtctggacaagtgctaaggacaagtgcaaacgtaaatcatgtcgtaatcctccagatcctgtgaatggcatggcacatgtgatcaaagacatccagttcagatcccaaattaaatattcttgtcctaaaggataccgactcattggttcctcgtctgccacatgcatcatctcaggcaacactgtcatttgggataataaaacacctgtttgtgacagtgatgacattagggagtgaggcctttggaaggtgatgagatcatgagagcagagctgtcacgaatgggattagcgtcctaataaaagaggcccagaagagctcctttgcccctcctgccatgggaagaaatgctgaatctgccagagaggttggtcctgaactccttagcctccacaactatgagaaataaatttttgttgtgtatgagctaaccagtttatagtattttgttataacagcccaaatagactaagaca

SEQ ID NO: 5809 - DNA, 554 bp, Artificial Sequence
  Synthetic polypeptide
attgggacatatctgaactatgaatgccgccctggttattccggaagaccgttttctatcatctgcctaaaaaactcagtctggacaagtgctaaggacaagtgcaaacgtaaatcatgtcgtaatcctccagatcctgtgaatggcatggcacatgtgatcaaagacatccagttcagatcccaaattaaatattcttgtcctaaaggataccgactcattggttcctcgtctgccacatgcatcatctcaggcaacactgtcatttgggataataaaacacctgtttgtgacagtgatgacattagggagtgaggcctttggaaggtgatgagatcatgagagcagagctgtcacgaatgggattagcgtcctaataaaagaggcccagaagagctcctttgcccctcctgccatgggaagaaatgctgaatctgccagagaggttggtcctgaactccttagcctccacaactatgagaaataaatttttgttgtgtatgagctaaccagtttatagtattttgttataacagcccaaatagactaagaca

SEQ ID NO: 5810 - DNA, 147 bp, Artificial Sequence
  Synthetic polypeptide
atgctcttcaattcggtgctccgccagccccagcttggcgtcctgagaaatggttgggccctaatgccttcttgtctggattgtaagaagtctcccagatggcctcctagtttgtctgtcttcggtttattctccacattgctgcta

SEQ ID NO: 5811 - DNA, 98 bp, Artificial Sequence; identical to SEQ ID NO: 3114
  Synthetic polypeptide

SEQ ID NO: 5812 - DNA, 5185 bp, Artificial Sequence
  Synthetic polypeptide
atgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccagtgggaggccagcttggctctacagcatgccagtgaggccctgttgacagtgagtgccaaggcccgccctgaggaccagaggcgccaggcagccaccagggacctgtttcaggctgtgggcagtgtgctggaagcttccctgagcaacagaccagaagagcctgcggaggccagcagcagccagattgccacagtgctgcggctgcttcgagtcatggagcatgtgcagaccaccctcctgctgggaaaactgccagggggccttccagccatgctggccaccccctccatctctgtgtacacaaacagaatacaaccctggagttggcaaggctcctccctgcgccctgatgccgcagactctgcaaccttcatgctgcccgctgcctcctccctcagctctctggagggcggccaggagcccgtggatataaagatcatgagtttcccaaagagcccctttccagcccgaagccactttgatgtcagcgggactgtcggtggcctccgtgtgaccagccctagtggtcaactcatacctgtgaagaatctgtcggagaatatcgagatcctgctgccccggcattcacaaagacacagccagccgaccgtgttgaacctgaccagtcctgaagctttgtgggtgaacgtgacttcaggggaggcaaccttggggatccagctgcactggagaccagacattgcactcacgcttagcctgggctatggctaccaccccaacaagagcagctacgatgcccaaactcacctcgtaccaatggtggctccagatgagctgcccacgtggatcctgagcccacaggacctgcgttttggagaaggggtctactatttgactgtggtccctgagtctgacctggagccagcccccggcagggacctcacggttggcatcaccaccttcctgtctcactgtgtgttctgggatgaggtccaggagacttgggacgactcaggatgccaggtggggcctcggaccagcccctaccagacacactgcctctgcaaccacctcactttcttcggaagcacgttcctggtgatgtccaatgccatcaacatccaccagactgctgagctctttgccacctttgaggacaaccctgtggtcgtgaccaccgtgggctgcctgtgtgtggtctacgtgctggtggtgatctgggcgaggaggaaggacgctcaggatcaggccaaggtgaaggtcacagtgctggaagacaatgatccctttgctcagtaccactacctggtgacagtctacacaggacaccgacgaggggcagccacgtcctcaaaggtgactgtcaccctgtatggcctggatggagagagagagccccaccacctggctgatcccgacactccggtttttgagcgaggagcagtggatgccttcctcctctccaccctgttccccctgggagaactgcggagcctccggctgtggcatgacaactcaggggaccggccatcgtggtatgtgagccgggtgctggtctatgacctggtgatggaccggaagtggtatttcctgtgcaactcctggctatccatcaatgttggagattgcgtcctcgataaggtgtttcctgtggccacggagcaggacagaaaacaattcagccacctgtttttcatgaagacttccgcgggcttccaggatggacacatctggtattcgatcttcagccgctgcgctcgcagcagcttcacccgcgtccagagggtgtcctgctgcttctccctgctgctgtgcaccatgctgaccagcatcatgttctggggggtccccaaggacccagctgagcaaaagatggacttgggtaaaattgaattcacctggcaggaggtgatgattggcctggagagctccatcctcatgttccccatcaacctcctgattgttcagatctttcagaacacccgtccccgggtcgcgaaggagcagaacactggaaaatgggaccgggggtcccccaacctgactccctccccacagcccatggaggacggccttctgacacctgaggcagtgaccaaggatgtgtcaagaatcgtcagctccctcttcaaagctctcaaggtgccatcccccgccttgggctgggactcagtgaacttgatggacatcaacagtctcctcgccttggtggaagatgtcatttatccacagaacacatcagggcaggtgttctgggaggaagccaaaaagagagaggaccctgtaacactcactttggggtcatcagaaatgaaagagaaatcacagtgtcccaagcccaaggcggcacggagtggcccctggaaggacagcgcctacaggcagtgtctgtaccttcagctggaacacgtggagcaagagctgcggctggtggggccccgaggcttctcccagccccacagccatgcctaggccctcaggcagctgcagaccctgaagggcggcctgggggtacagccgggcacctgggcccctgcacatgccagcgctcttcaggtgagcaaaccccctcaaggcctgccctggtggtgcatcctggtgggctggctcctggtagcggccaccagtggcgtggcggccttcttcaccatgctctacggcctgcactacgggagggccagctccctcaggtggctcatctccatggctgtctccttcgtggagagcatgttcgtcacccagcccctgaaggtgctgggattcgctgctttctttgcactggtcttgaagagagtggacgatgaggaggatactgtggccccgctgccaggacatctgttgggcccagacccctatgccttgttccgagcacgaagaaacagcagcagggatgtctaccagccacctctcaccgctgccattgagaagatgaaaaccacccacctcaaggaacagaaagcatttgccctcatcagagaaatcctggcatacttgggcttcctgtggatgctactgctcgtggcctacgggcagagggaccccagcgcctaccacctcaacagacacctccagcacagcttcaccaggggcttttcaggtgtgctcggcttccgagagttcttcaagtgggccaacaccaccctcgtgagtaacctgtatggtcaccccccaggctttatcactgatgggaactccaagctggttggcagtgcccagattcgtcaagtgagggtccaggaaagctcttgccctcttgcccagcagccgcaggcatatctcaacggatgccgtgcaccatattccctggatgctgaagacatggcagactatggggaaggctggaatgccaccaccctcagtaatggcagtaccagagccaggaccaacgtcaagggtatcccatctggggcaaactcactgtgtaccggggaggaggctacgtggtccccttggggactgatcgccaaagcacgtcaagaattctccgctatctctttgacaacacctggctggacgccctgaccagagctgtgtttgtggagtccactgtctacaacgccaacgtcaacctgttctgcattgtcacgctgacgctagagaccagcgctctgggcaccttttttacgcacgcggccctgcagagcctccgcctgtaccccttcaccgacggctggcaccccttcgtggtagcggcagagctcatctacttcctcttcctcctctactacatggtggtgcagggcaagcgcatgagtaaagagacgtggggctatttctgcagcaagtggaaccttctggagctggccatcatcctggccagctggagcgccctggcggtgtttgtgaagagggctgtcctggccgaaagggacctccagcgctgccggaaccacagggaggaaggcatcagcttcagtgagacagcagcagccgatgccgcccttggctacatcattgccttcctggtactcctgtccacagtgaagctttggcatctgctcaggttgaatcccaaaatgaacatgatcacggcagccctacgccgtgcctggggcgacatttcaggctttatgattgtcatccttaccatgctcctggcttactccatcgcgtcaaacttgatatttggttggaaactccgttcctacaaaaccctctttgatgcggcggagacgatggtcagccttcagctgggaatcttcaactacgaggaggtcctggactatagcccagtgcttggctccttcctcattggatcctgcattgtttttatgacatttgtggtgctgaacctgtttatctctgtcatcctggtggccttcagtgaggagcaaaaatactatcagagacttgaccatccgaggatttt

SEQ ID NO: 5813 - DNA, 7240 bp, Artificial Sequence
  Synthetic polypeptide
atgagtgcagtgggcttggtactcctggtgcttgctctgaggcttagggccaccactgttaagccagaggaaggcagcttttgctctaacagccaggtggccttcagagatgcttgctatgaatttgtgccactcggacgcaccttccgtgatgcccagagctggtgcgaggggcaaggaggccatttggtcttcattcaggacgaaggcacccagtggtttctgcagaagcacatctcccaggacagggaatggtggattggactcacgtggaacttggcacggaatggaaccacggaggggccggggacttggttggacacctccaatgtgacctacagcaactggcatggagggcaggccgccgctgcccctgacacctgcggccacatcgggagaggcccttcctctgagtgggtgacctcggactgcgcccagaccttcgccttcatgtgcgagttccgggttggccagagcctggcctgcgagggactcaatgccaccgtgcactgtggcttggggcaggtcatccaggtccaggatgccgtctacgggcgccagaatccccatttctgcacccaggatgccgggcgtccttcagatctggagcagggatgcagctgggccaacgtcaaggaggaggtggcaggccagtgccaggagctacagtcatgccaggtggcagcagatgagacctactttggaaacctgtgtccgactcagggcagttacctgtgggtgcagtaccagtgccgggaagccctgcagctgatggtgtccagtgagagtttcatctttgacaatgtcaccatctccctgacgtggctcctctcaccctacataggaaacctgtcctgtataattagtacaggagacagccacacttttgatccctacaacccgccgagtgtgtccagcaatgtgacccaccagttcacatctcctggggaattcaccgtgtttgctgaatgcacaaccagtgagtggcatgtgacagctcagaggcaggtgaccgtgcgagacaagatggagacgctcagtgtgactgcatgctccggcctgtcccagtcaggagccggccctctctgccaggctgtctttggggatcctctgtggattcaggtggagcttgatggaggaacaggagtgacttacactgtgcttttgggtgacataaccctggccgagtccaccacccaaaagggctcgctaccgtacaatctgatcctggacagagaaacccagaaactgatgggccctgggaggcaccgcctggagatccaagccaccggcaacaccaccacctctacaatctccagaaacattacagtccacttggtggagctgctgtcagggctgcaggcctcctgggcttctgaccatttggagcttggacaggacctattgatcaccatctcattggctcagggcaccccggaagagctgacctttgaggtggctggactcaatgcaaccttctcccacgagcaagtgagctttggagagccatttgggatttgccgcctggctgttccggttgaaggcacctttctggtcaccatgctggtgaggaatgccttctccaacctgagtttggaaatcgggaacatcactatcacagccccttccggtctccaagaaccatctgggatgaatgctgaaggaaagagtaaagataaaggcgatatggaggtgtacatccaacctggtccatatgtggatcctttcacgacagtgaccctgggctggccagacaatgacaaggagttacgcttccaatggtcatgtgggtcttgctgggctctgtggagcagctgtgttgagaggcagctgcttcgcacagaccagagggagctggtggttccagcatcctgcctgccgccgcctgactctgctgtcaccctgcgcctggctgttctgagaggccaagagctggagaacagggcagagcagtgcctctacgtgtctgcgccctgggaactcaggcctcgagtcagctgtgagaggaactgcaggccagttaatgccagcaaagacattctgctcagggtcaccatgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccagtgggaggccagcttggctctacagcatgccagtgaggccctgttgacagtgagtgccaaggcccgccctgaggaccagaggcgccaggcagccaccagggacctgtttcaggctgtgggcagtgtgctggaagcttccctgagcaacagaccagaagagcctgcggaggccagcagcagccagattgccacagtgctgcggctgcttcgagtcatggagcatgtgcagaccaccctcctgctgggaaaactgccagggggccttccagccatgctggccaccccctccatctctgtgtacacaaacagaatacaaccctggagttggcaaggctcctccctgcgccctgatgccgcagactctgcaaccttcatgctgcccgctgcctcctccctcagctctctggagggcggccaggagcccgtggatataaagatcatgagtttcccaaagagcccctttccagcccgaagccactttgatgtcagcgggactgtcggtggcctccgtgtgaccagccctagtggtcaactcatacctgtgaagaatctgtcggagaatatcgagatcctgctgccccggcattcacaaagacacagccagccgaccgtgttgaacctgaccagtcctgaagctttgtgggtgaacgtgacttcaggggaggcaaccttggggatccagctgcactggagaccagacattgcactcacgcttagcctgggctatggctaccaccccaacaagagcagctacgatgcccaaactcacctcgtaccaatggtggctccagatgagctgcccacgtggatcctgagcccacaggacctgcgttttggagaaggggtctactatttgactgtggtccctgagtctgacctggagccagcccccggcagggacctcacggttggcatcaccaccttcctgtctcactgtgtgttctgggatgaggtccaggagacttgggacgactcaggatgccaggtggggcctcggaccagcccctaccagacacactgcctctgcaaccacctcactttcttcggaagcacgttcctggtgatgtccaatgccatcaacatccaccagactgctgagctctttgccacctttgaggacaaccctgtggtcgtgaccaccgtgggctgcctgtgtgtggtctacgtgctggtggtgatctgggcgaggaggaaggacgctcaggatcaggccaaggtgaaggtcacagtgctggaagacaatgatccctttgctcagtaccactacctggtgacagtctacacaggacaccgacgaggggcagccacgtcctcaaaggtgactgtcaccctgtatggcctggatggagagagagagccccaccacctggctgatcccgacactccggtttttgagcgaggagcagtggatgccttcctcctctccaccctgttccccctgggagaactgcggagcctccggctgtggcatgacaactcaggggaccggccatcgtggtatgtgagccgggtgctggtctatgacctggtgatggaccggaagtggtatttcctgtgcaactcctggctatccatcaatgttggagattgcgtcctcgataaggtgtttcctgtggccacggagcaggacagaaaacaattcagccacctgtttttcatgaagacttccgcgggcttccaggatggacacatctggtattcgatcttcagccgctgcgctcgcagcagcttcacccgcgtccagagggtgtcctgctgcttctccctgctgctgtgcaccatgctgaccagcatcatgttctggggggtccccaaggacccagctgagcaaaagatggacttgggtaaaattgaattcacctggcaggaggtgatgattggcctggagagctccatcctcatgttccccatcaacctcctgattgttcagatctttcagaacacccgtccccgggtcgcgaaggagcagaacactggaaaatgggaccgggggtcccccaacctgactccctccccacagcccatggaggacggccttctgacacctgaggcagtgaccaaggatgtgtcaagaatcgtcagctccctcttcaaagctctcaaggtgccatcccccgccttgggctgggactcagtgaacttgatggacatcaacagtctcctcgccttggtggaagatgtcatttatccacagaacacatcagggcaggtgttctgggaggaagccaaaaagagagaggaccctgtaacactcactttggggtcatcagaaatgaaagagaaatcacagtgtcccaagcccaaggcggcacggagtggcccctggaaggacagcgcctacaggcagtgtctgtaccttcagctggaacacgtggagcaagagctgcggctggtggggccccgaggcttctcccagccccacagccatgcctaggccctcaggcagctgcagaccctgaagggcggcctgggggtacagccgggcacctgggcccctgcacatgccagcgctcttcaggtgagcaaaccccctcaaggcctgccctggtggtgcatcctggtgggctggctcctggtagcggccaccagtggcgtggcggccttcttcaccatgctctacggcctgcactacgggagggccagctccctcaggtggctcatctccatggctgtctccttcgtggagagcatgttcgtcacccagcccctgaaggtgctgggattcgctgctttctttgcactggtcttgaagagagtggacgatgaggaggatactgtggccccgctgccaggacatctgttgggcccagacccctatgccttgttccgagcacgaagaaacagcagcagggatgtctaccagccacctctcaccgctgccattgagaagatgaaaaccacccacctcaaggaacagaaagcatttgccctcatcagagaaatcctggcatacttgggcttcctgtggatgctactgctcgtggcctacgggcagagggaccccagcgcctaccacctcaacagacacctccagcacagcttcaccaggggcttttcaggtgtgctcggcttccgagagttcttcaagtgggccaacaccaccctcgtgagtaacctgtatggtcaccccccaggctttatcactgatgggaactccaagctggttggcagtgcccagattcgtcaagtgagggtccaggaaagctcttgccctcttgcccagcagccgcaggcatatctcaacggatgccgtgcaccatattccctggatgctgaagacatggcagactatggggaaggctggaatgccaccaccctcagtaatggcagtaccagagccaggaccaacgtcaagggtatcccatctggggcaaactcactgtgtaccggggaggaggctacgtggtccccttggggactgatcgccaaagcacgtcaagaattctccgctatctctttgacaacacctggctggacgccctgaccagagctgtgtttgtggagtccactgtctacaacgccaacgtcaacctgttctgcattgtcacgctgacgctagagaccagcgctctgggcaccttttttacgcacgcggccctgcagagcctccgcctgtaccccttcaccgacggctggcaccccttcgtggtagcggcagagctcatctacttcctcttcctcctctactacatggtggtgcagggcaagcgcatgagtaaagagacgtggggctatttctgcagcaagtggaaccttctggagctggccatcatcctggccagctggagcgccctggcggtgtttgtgaagagggctgtcctggccgaaagggacctccagcgctgccggaaccacagggaggaaggcatcagcttcagtgagacagcagcagccgatgccgcccttggctacatcattgccttcctggtactcctgtccacagtgaagctttggcatctgctcaggttgaatcccaaaatgaacatgatcacggcagccctacgccgtgcctggggcgacatttcaggctttatgattgtcatccttaccatgctcctggcttactccatcgcgtcaaacttgatatttggttggaaactccgttcctacaaaaccctctttgatgcggcggagacgatggtcagccttcagctgggaatcttcaactacgaggaggtcctggactatagcccagtgcttggctccttcctcattggatcctgcattgtttttatgacatttgtggtgctgaacctgtttatctctgtcatcctggtggccttcagtgaggagcaaaaatactatcagagacttgaccatccgaggatttt

SEQ ID NO: 5814 - DNA, 1493 bp, Artificial Sequence; identical to SEQ ID NO: 1536
  Synthetic polypeptide

SEQ ID NO: 5815 - DNA, 1229 bp, Artificial Sequence
  Synthetic polypeptide
atgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattaggaaatctgtctttaaatactgaaggaagttcttcaagctgaaaataagtgacaccagacggttattaacatccacatgaacaaataaagaggc

SEQ ID NO: 5816 - DNA, 239 bp, Artificial Sequence
  Synthetic polypeptide
atgggtcatcttactctggaagactatcagatctggagtgtgaaaaatgttcttgccaatgagtttttgaacctccttttccaggtgtgtcacatagttctggggttaagaccagctactccggaagaagaaggacaaattattaggaaatctgtctttaaatactgaaggaagttcttcaagctgaaaataagtgacaccagacggttattaacatccacatgaacaaataaagaggc

SEQ ID NO: 5817 - DNA, 1220 bp, Artificial Sequence
  Synthetic polypeptide
atgcgttacgtgcggagatgcgtccccctccccggcgctcctgcgcgcgttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattaggaaatctgtctttaaatactgaaggaagttcttcaagctgaaaataagtgacaccagacggttattaacatccacatgaacaaataaagaggc

SEQ ID NO: 5818 - DNA, 341 bp, Artificial Sequence
  Synthetic polypeptide
atgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgtgtcacatagttctggggttaagaccagctactccggaagaagaaggacaaattattaggaaatctgtctttaaatactgaaggaagttcttcaagctgaaaataagtgacaccagacggttattaacatccacatgaacaaataaagaggc

SEQ ID NO: 5819 - DNA, 611 bp, Artificial Sequence
  Synthetic polypeptide
atgaagcacctgaagcggtggtggtcggccggcggcggcctcctgcacctcaccctcctgctgagcttggcggggctccgcgtagacctagatctttacctgctgctgccgccgcccaccctgctgcaggacgagctgctgttcctgggcggcccggccagctccgcctacgcgctcagccccttctcggcctcgggagggtgggggcgcgcgggccacttgcaccccaagggccgggagctggaccctgccgcgccgcccgagggccagctgctccgggaggtgcgcgcgctcggggtccccttcgtccctcgcaccagcgtggatgcatggctggtgcacagcgtggctgccgggagcgcggacgaggcccacgggctgctcggcgccgccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggataacagtgataccaaggcctaaaaaagcacatcagagaa

SEQ ID NO: 5820 - DNA, 1255 bp, Artificial Sequence
  Synthetic polypeptide
atgaagcctcacttcagaaacacagtggagcgaatgtatcgagacacattctcctacaacttttataatagacccatcctttctcgtcggaataccgtctggctgtgctacgaagtgaaaacaaagggtccctcaaggccccgtttggacgcaaagatctttcgaggccaggtgtattcccagcctgagcaccacgcagaaatgtgcttcctctcttggttctgtggcaaccagctgcctgcttacaagtgtttccagatcacctggtttgtatcctggaccccctgcccggactgtgtggcgaagctggccgaattcctggctgagcaccccaatgtcaccctgaccatctccgccgcccgcctctactactactgggaaagagattaccgaagggcgctctgcaggctgagtcaggcaggggcccgcgtgaagattatggacgatgaagaatttgcatactgctgggaaaactttgtgtacagtgaaggtcagccattcatgccttggtacaaattcgatgacaattatgcattcctgcaccgcacgctaaaggagattctcagaaacccgatggaggcaatgtatccacacatattctacttccactttaaaaacctacgcaaagcctatggtcggaacgaaagctggctgtgcttcaccatggaagttgtaaagcaccactcacctgtctcctggaagaggggcgtcttccgaaaccaggtggatcctgagacccattgtcatgcagaaaggtgcttcctctcttggttctgtgacgacatactgtctcctaacacaaactacgaggtcacctggtacacatcttggagcccttgcccagagtgtgcaggggaggtggccgagttcctggccaggcacagcaacgtgaatctcaccatcttcaccgcccgcctctactacttctgggatacagattaccaggaggggctccgcagcctgagtcaggaaggggcctccgtggagatcatgggctacaaagctaaaacagagcccaggagccagggaggaaaagcagtcaggccacacaccattgctcccaaaatggacttctctgcaagcctgactcctgaaactgtgcattgtaccctgaaaccagctttatccatagcttctgcaataaatggctgtaagtcttggactccttgctataatcgcagctattcagcaatggaacctcccagttcccaacccttcctagtgcccatgggctttcccataggacaagagaaca

SEQ ID NO: 5821 - DNA, 1206 bp, Artificial Sequence; identical to SEQ ID NO: 282
  Synthetic polypeptide

SEQ ID NO: 5822 - DNA, 1209 bp, Artificial Sequence; identical to SEQ ID NO: 281
  Synthetic polypeptide

SEQ ID NO: 5823 - DNA, 1203 bp, Artificial Sequence; identical to SEQ ID NO: 286
  Synthetic polypeptide

SEQ ID NO: 5824 - DNA, 215 bp, Artificial Sequence
  Synthetic polypeptide
atggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcggggaattatacctacccttgcagag

SEQ ID NO: 5825 - DNA, 1411 bp, Artificial Sequence
  Synthetic polypeptide
atgcgcctgactcacatctgctgctgctgcctcctttaccagctggggttcctgtcgaatgggatcgtttcagagctgcagttcgcccccgaccgcgaggagtgggaagtcgtgtttcctgcgctctggcgccgggagccggtggacccggctggcggcagcgggggcagcgcggacccgggctgggtgcgcggcgttgggggcggcggaagcgcccgggcgcaggctgccggcagctcacgcgaggtgcgctctgtggctccggtgcctttggaggagcccgtggagggccgatcagagtcccggctccggcccccgccgccgtcggagggtgaggaggacgaggagctcgagtcgcaggagctgccgcggggatccagcggggctgccgccttgtccccgggcgccccggcctcgtggcagccgccgcctcccccgcagccgcccccgtccccgcccccggcccagcatgccgagccggatggcgacgaagtgttgctgcggatcccggccttctctcgggacctgtacctgctgctccggagagacggccgcttcctggcgccgcgcttcgcagtggaacagcggccaaatcccggccccggccccacgggggcagcatccgccccgcaacctcccgcgccaccagacgcaggctgcttctacaccggagctgtgctgcggcaccctggctcgctggcttctttcagcacctgtggaggtggcctgatgggatttatacagctcaatgaggacttcatatttattgagccactcaatgatacaatggccataacaggtcacccacaccgtgtatataggcagaaaaggtccatggaggaaaaggtcacagagaagtcagctcttcacagtcattactgtggtatcatttcagataaaggaagacctaggtctagaaaaatagcagaaagtggaagagggaaacgatattcatacaaattacctcaagaatacaacatagagactgtagtggttgcagacccagcaatggtttcctatcatggagcagatgcagccaggagattcattctaaccatcttaaatatggtatttaaccttttccaacacaagagtctgagtgtgcaggtcaatcttcgtgtgataaagcttattctgctccatgaaactccaccagaactatatattgggcatcatggagaaaaaatgctagagagtttttgtaagtggcaacatgaagaatttggcaaaaagaatgatatacatttagagatgtcaacaaactggggggaagacatgacttcagtggatgcagctatacttataacaaggtgaatggatgtattgtgtgatcatacaattgaatactcttcatcaaactgctaataaatgcaaccacatggatggatgaatatgaatatcattatactga

SEQ ID NO: 5826 - DNA, 5394 bp, Artificial Sequence; identical to SEQ ID NO: 3213
  Synthetic polypeptide

SEQ ID NO: 5827 - DNA, 5259 bp, Artificial Sequence; identical to SEQ ID NO: 3214
  Synthetic polypeptide

SEQ ID NO: 5828 - DNA, 5409 bp, Artificial Sequence; identical to SEQ ID NO: 3215
  Synthetic polypeptide

SEQ ID NO: 5829 - DNA, 5403 bp, Artificial Sequence; identical to SEQ ID NO: 3216
  Synthetic polypeptide

SEQ ID NO: 5830 - DNA, 272 bp, Artificial Sequence; identical to SEQ ID NO: 3217
  Synthetic polypeptide

SEQ ID NO: 5831 - DNA, 657 bp, Artificial Sequence; identical to SEQ ID NO: 180
  Synthetic polypeptide

SEQ ID NO: 5832 - DNA, 423 bp, Artificial Sequence; identical to SEQ ID NO: 179
  Synthetic polypeptide

SEQ ID NO: 5833 - DNA, 568 bp, Artificial Sequence; identical to SEQ ID NO: 1967
  Synthetic polypeptide

SEQ ID NO: 5834 - DNA, 379 bp, Artificial Sequence; identical to SEQ ID NO: 1968
  Synthetic polypeptide

SEQ ID NO: 5835 - DNA, 4277 bp, Artificial Sequence; identical to SEQ ID NO: 2069
  Synthetic polypeptide

SEQ ID NO: 5836 - DNA, 451 bp, Artificial Sequence; identical to SEQ ID NO: 339
  Synthetic polypeptide

SEQ ID NO: 5837 - DNA, 2230 bp, Artificial Sequence
  Synthetic polypeptide
atgaaagtgattgtaatccataggaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagcggatgataatctcaagacacctcccgagtgtctgctcactccccttccaccctcagctccaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgataatctcaagacaccttccgagcgtcagctcactccccttccaccctcagctccactctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttctgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacatggaaccac

SEQ ID NO: 5838 - DNA, 715 bp, Artificial Sequence; identical to SEQ ID NO: 1181
  Synthetic polypeptide

SEQ ID NO: 5839 - DNA, 589 bp, Artificial Sequence; identical to SEQ ID NO: 1182
  Synthetic polypeptide

SEQ ID NO: 5840 - DNA, 352 bp, Artificial Sequence; identical to SEQ ID NO: 1183
  Synthetic polypeptide

SEQ ID NO: 5841 - DNA, 180 bp, Artificial Sequence; identical to SEQ ID NO: 1184
  Synthetic polypeptide

SEQ ID NO: 5842 - DNA, 226 bp, Artificial Sequence; identical to SEQ ID NO: 1185
  Synthetic polypeptide

SEQ ID NO: 5843 - DNA, 280 bp, Artificial Sequence; identical to SEQ ID NO: 1186
  Synthetic polypeptide

SEQ ID NO: 5844 - DNA, 2739 bp, Artificial Sequence
  Synthetic polypeptide
atgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattcctttgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaatcatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcaccaggtctaaactgcagtaatccatttactcagctggagaggagacatcaagaacatgccagacacatttcttttggtggtgtcctatagtcagtgactgatcaaagtgggggtataaaaaggcctggccccgcttgaagctctgaagaagaatcccagcttcagaactccccctagggtagggtaagttattgctgctcaacttctccctcaactcaatcatgtctttcccatccccacatgtattgattgcaagtacactccctcacaagcttcttgagatctaatctctctgcttcctgggagacccaacctgtgaca

SEQ ID NO: 5845 - DNA, 415 bp, Artificial Sequence; identical to SEQ ID NO: 4339
  Synthetic polypeptide

SEQ ID NO: 5846 - DNA, 1266 bp, Artificial Sequence
  Synthetic polypeptide
atgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctgtgagttgctcagcagcagctttattacctgtatggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctgttttcaacaacaacaaaagatgtgaagaaacagcaattacagccgcctatatatgggggaaaaaacttagaaaacagaaaccatccctgagaaaacccagacattagatctattaaacaaaaagtttgtcaacctttaaatatgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacagtcgttaaagcagcaggagaaaaacaacttatcacatacaagggatcctgtgtaagattaaatgcctaccactcatcagaaactacagaggtcagaaggctgtagaatgacatattcaaagtgctaaaagaaaaaaacttaacagagaattttagatccagcaaaactatccttcaaaactataagaaaggat

SEQ ID NO: 5847 - DNA, 1008 bp, Artificial Sequence
  Synthetic polypeptide
atggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctgttttcaacaacaacaaaagatgtgaagaaacagcaattacagccgcctatatatgggggaaaaaacttagaaaacagaaaccatccctgagaaaacccagacattagatctattaaacaaaaagtttgtcaacctttaaatatgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacagtcgttaaagcagcaggagaaaaacaacttatcacatacaagggatcctgtgtaagattaaatgcctaccactcatcagaaactacagaggtcagaaggctgtagaatgacatattcaaagtgctaaaagaaaaaaacttaacagagaattttagatccagcaaaactatccttcaaaactataagaaaggat

SEQ ID NO: 5848 - DNA, 936 bp, Artificial Sequence
  Synthetic polypeptide
gagtcctctcaagagaataaaactgtgtcagaggctgaatcaagaatcttttggttgggacttattgcctgttcagtactgtgggtgatatttgcctttagtgcactcttctccttcacagtaaagtggctgttttcaacaacaacaaaagatgtgaagaaacagcaattacagccgcctatatatgggggaaaaaacttagaaaacagaaaccatccctgagaaaacccagacattagatctattaaacaaaaagtttgtcaacctttaaatatgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacagtcgttaaagcagcaggagaaaaacaacttatcacatacaagggatcctgtgtaagattaaatgcctaccactcatcagaaactacagaggtcagaaggctgtagaatgacatattcaaagtgctaaaagaaaaaaacttaacagagaattttagatccagcaaaactatccttcaaaactataagaaaggat

SEQ ID NO: 5849 - DNA, 1074 bp, Artificial Sequence
  Synthetic polypeptide
atggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctgttttcaacaacaacaaaagatgtgaagaaacagcaattacagccgcctatatatgggggaaaaaacttagaaaacagaaaccatccctgagaaaacccagacattagatctattaaacaaaaagtttgtcaacctttaaatatgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacagtcgttaaagcagcaggagaaaaacaacttatcacatacaagggatcctgtgtaagattaaatgcctaccactcatcagaaactacagaggtcagaaggctgtagaatgacatattcaaagtgctaaaagaaaaaaacttaacagagaattttagatccagcaaaactatccttcaaaactataagaaaggat

SEQ ID NO: 5850 - DNA, 410 bp, Artificial Sequence
  Synthetic polypeptide
atgtgcggcaataacatgtcaaccccgctgcccgccatcgtgcccgccgcccggaaggccaccgctgcggtgattttcctgcatggattgggagatactggatgcggtggctcatgcctgtaatctcagcactttgggaggtggaggcgggcggatcacctgaggtcaggagttcaggaccagcctggccaacatggcgaaaccccatctctactaaaaatacaaaaattagccaggtgtggtggcacatgcctgtaatcgcagctacttgggaggctgaggcaggagaatcacttgaacctgggaggcggagattgcagtgagccaagatcgcaccattgcactccagcctgggcaacaagagcagaagagcagaactctgtctcaaaaaaaaaaaaaacgaaaagaaa

SEQ ID NO: 5851 - DNA, 690 bp, Artificial Sequence
  Synthetic polypeptide
atgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaagaaactctacaagccagaagagagtggggaccaatattcaacattcttaaagaaaagaattttcaaccaagaatttcatatccagccaaactaagcttcataagtgaaggagaaataaaatactttacagacaagcaaatgctgggagattttgtcaccaccaggcctgccctaaatgagctcctgaaggaagcactaaacatggaaaggaacaacaggtaccagccactgcaaaaacatgacaaattgtaaagaccatcaaggctaggaagaaactgcatcaactaacgagcaaaatcaccagctaacatcataatgacaggatcaaattcacacataacaatattaactttaaatgtaaatgtgctaaatgctccaattaaaagacacaaac

SEQ ID NO: 5852 - DNA, 1479 bp, Artificial Sequence
  Synthetic polypeptide
atggagcagcgccgcgtcaccgacttcttcgcgcgccgccgccccgggcccccccgcatcgcgccgcccaagctggcctgccgcacccccagccccgccaggcccgcactccgcgccccggcctccgctaccagtggcagccgcaagcgcgcccgcccgcccgccgcccccggacgcgaccaggccaggccaccggcccgcaggagactgcggctgtcggtggacgaggtttccagccccagtacccccgaggccccagacatcccagcctgcccttctccgggccagaagataaagaaatccaccccggcagcaggtcagccgccccacctgacatccgcgcaggaccaggacaccatctctgagcttgcgtcatgcctgcaacgggcccgggagctgggggcaagagtccgggcgctgaaggccagtgcccaggatgctggggagtcctgcaccccagaggccgagggccgccctgaggagccatgtggcgagaaggcgcccgcctaccagcgcttccatgccctggcccagcccggcctgccgggactcgtgctgccctacaagtaccaggtgctggcggagatgttccgcagcatggacaccatcgtgggcatgctccacaaccgctccgagacgcccacctttgccaaggtccagcggggcgtccaggacatgatgcgtaggcgttttgaggagtgcaatgttggccagatcaaaaccgtgtacccggcctcctaccgcttccgccaggagcgcagtgtccccaccttcaaggatggcaccaggaggtcagattaccagctcaccatcgagccactgctggagcaggaggctgacggagcagccccccagctcacggcctcgcgcctcctgcagcgacggcagatcttcagccagaagctggtggagcatgtcaaggagcaccacaaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccaggatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcggatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggg

SEQ ID NO: 5853 - DNA, 506 bp, Artificial Sequence; identical to SEQ ID NO: 1096
  Synthetic polypeptide

SEQ ID NO: 5854 - DNA, 495 bp, Artificial Sequence
  Synthetic polypeptide
atggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacagccagagctcaggcatatgacacagagccagccaatcagatgcagtcacctgagtttggaagaaagaagtgtgaagaaggtggtgctgtgtggaatctgtcctgatgaaggtggaagaactggcagagagataggcttttgggggtggcaaatggtagaaatcttaactatagcattctctgctcccaagatgcgaggtgtggtatctgtgcccagtggtag

SEQ ID NO: 5855 - DNA, 270 bp, Artificial Sequence
  Synthetic polypeptide
atgaaaccagcgctcttcagcgtcctgtgtgagatcaaagagaaaacagccagagctcaggcatatgacacagagccagccaatcagatgcagtcacctgagtttggaagaaagaagtgtgaagaaggtggtgctgtgtggaatctgtcctgatgaaggtggaagaactggcagagagataggcttttgggggtggcaaatggtagaaatcttaactatagcattctctgctcccaagatgcgaggtgtggtatctgtgcccagtggtag

SEQ ID NO: 5856 - DNA, 1692 bp, Artificial Sequence; identical to SEQ ID NO: 1048
  Synthetic polypeptide

SEQ ID NO: 5857 - DNA, 1695 bp, Artificial Sequence; identical to SEQ ID NO: 1049
  Synthetic polypeptide

SEQ ID NO: 5858 - DNA, 466 bp, Artificial Sequence; identical to SEQ ID NO: 1050
  Synthetic polypeptide

SEQ ID NO: 5859 - DNA, 1868 bp, Artificial Sequence
  Synthetic polypeptide
atggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgatttgttgacagcggtttcctggagtgctgtcttgagaacgattctgaggaggctcagcaagaaagagtgtttcagttgattgggtgtgtctgtcatggagaaggaagtaaggagtgg

SEQ ID NO: 5860 - DNA, 1805 bp, Artificial Sequence
  Synthetic polypeptide
atggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgatttgttgacagcggtttcctggagtgctgtcttgagaacgattctgaggaggctcagcaagaaagagtgtttcagttgattgggtgtgtctgtcatggagaaggaagtaaggagtgg

SEQ ID NO: 5861 - DNA, 1808 bp, Artificial Sequence
  Synthetic polypeptide
atggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgatttgttgacagcggtttcctggagtgctgtcttgagaacgattctgaggaggctcagcaagaaagagtgtttcagttgattgggtgtgtctgtcatggagaaggaagtaaggagtgg

SEQ ID NO: 5862 - DNA, 1745 bp, Artificial Sequence
  Synthetic polypeptide
atggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgatttgttgacagcggtttcctggagtgctgtcttgagaacgattctgaggaggctcagcaagaaagagtgtttcagttgattgggtgtgtctgtcatggagaaggaagtaaggagtgg

SEQ ID NO: 5863 - DNA, 266 bp, Artificial Sequence; identical to SEQ ID NO: 2578
  Synthetic polypeptide

SEQ ID NO: 5864 - DNA, 944 bp, Artificial Sequence
  Synthetic polypeptide
atggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagagggccaagatataatgcctgg

SEQ ID NO: 5865 - DNA, 815 bp, Artificial Sequence
  Synthetic polypeptide
atggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaaggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagagggccaagatataatgcctgg

SEQ ID NO: 5866 - DNA, 110 bp, Artificial Sequence
  Synthetic polypeptide
ctacagactctgaatgcttgctgtgctgtgtatggacagaaggaactgaaggacttcctccccagcctttgggcttctatccgcagagagggccaagatataatgcctgg

SEQ ID NO: 5867 - DNA, 917 bp, Artificial Sequence
  Synthetic polypeptide
atggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagagggccaagatataatgcctgg

SEQ ID NO: 5868 - DNA, 1310 bp, Artificial Sequence; identical to SEQ ID NO: 1882
  Synthetic polypeptide

SEQ ID NO: 5869 - DNA, 395 bp, Artificial Sequence; identical to SEQ ID NO: 1883
  Synthetic polypeptide

SEQ ID NO: 5870 - DNA, 371 bp, Artificial Sequence; identical to SEQ ID NO: 1884
  Synthetic polypeptide

SEQ ID NO: 5871 - DNA, 1928 bp, Artificial Sequence; identical to SEQ ID NO: 2598
  Synthetic polypeptide

SEQ ID NO: 5872 - DNA, 1034 bp, Artificial Sequence; identical to SEQ ID NO: 1229
  Synthetic polypeptide

SEQ ID NO: 5873 - DNA, 616 bp, Artificial Sequence; identical to SEQ ID NO: 1230
  Synthetic polypeptide

SEQ ID NO: 5874 - DNA, 1158 bp, Artificial Sequence
  Synthetic polypeptide
atgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggatgaggacgatggcagagacgctgctccccccggaagactccctcagaagctgctcctggagacagctgccccgagggtctcctccagtagacggtacagcgaaggcagagagttcagagggaggaaatggaaagcaaaaaataccccaaagaaggcaagaaagagcaaaaggaagtagagcagatgtgataaaccaacccgatccgacggtggcccagctccctccacatcacactaaatgtaaccggaccagacagcctcattaaaaggaaaaattgttatgctacctttttaaaaggcaggctgcttacacaagtagaagaatatagaatggttaaatgtgaaaagacggaagatgaaagtaccacagtgaccagagagccggtgccgtggccat

SEQ ID NO: 5875 - DNA, 587 bp, Artificial Sequence
  Synthetic polypeptide
atgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacaggccaggcacggtggctcatgcctgtaatcccagcactttcggaggccgaggcgggtggatcacctgaagtgaggagttcatgaccagccttgccaatatggcaaaacaccttctctatgaaaaatacgaaaactagcccagcgtggtgtcacgtgcctgtaatcccagctactcggaaggctaaggcaggagaattgcttggacctgggaggcagaggttgcagtgagctgagatcgtgccactgcactccagcctgggcaacagagtgagactctgtctcaaaaaaataaaaataaaaaa

SEQ ID NO: 5876 - DNA, 581 bp, Artificial Sequence
  Synthetic polypeptide
atgaacgcgagcagcgagggcgagagcttcgcgggctcggtgcaaagtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacaggccaggcacggtggctcatgcctgtaatcccagcactttcggaggccgaggcgggtggatcacctgaagtgaggagttcatgaccagccttgccaatatggcaaaacaccttctctatgaaaaatacgaaaactagcccagcgtggtgtcacgtgcctgtaatcccagctactcggaaggctaaggcaggagaattgcttggacctgggaggcagaggttgcagtgagctgagatcgtgccactgcactccagcctgggcaacagagtgagactctgtctcaaaaaaataaaaataaaaaa

SEQ ID NO: 5877 - DNA, 336 bp, Artificial Sequence
  Synthetic polypeptide
atgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcgtacttcaggaggcagaggcagaaggatcacttgaactcaggagtttgagaccagcctgagcaacatagttagacaccatctccac

SEQ ID NO: 5878 - DNA, 162 bp, Artificial Sequence
  Synthetic polypeptide
gcgctgctgaacgctttcaccgcaacttttgagctaagtgatgatggccgctttgaggtgtggaatgcgatgactcgtacttcaggaggcagaggcagaaggatcacttgaactcaggagtttgagaccagcctgagcaacatagttagacaccatctccac

SEQ ID NO: 5879 - DNA, 138 bp, Artificial Sequence
  Synthetic polypeptide
acttttgagctaagtgatgatggccgctttgaggtgtggaatgcgatgactcgtacttcaggaggcagaggcagaaggatcacttgaactcaggagtttgagaccagcctgagcaacatagttagacaccatctccac

SEQ ID NO: 5880 - DNA, 734 bp, Artificial Sequence; identical to SEQ ID NO: 930
  Synthetic polypeptide

SEQ ID NO: 5881 - DNA, 643 bp, Artificial Sequence
  Synthetic polypeptide
atgaagaagaagttagtggtgctgggcctgctggccgtggtcctggtgctggtcattgtcggcctctgtctctggctgccctcggcctccaaggaacctgacaaccatgtgtacaccagggctgccatggccgcggatgccaagcagtgcttggagattgggagggacacactgcgggacggtggctctgcagtggatgcagccattgcagccctgttgtgtgtggggctcatgaatgcccacagcatgggcatcggggttggcctcttcctcaccatctacaacagcaccactcgaaaagctgaggtcatcaatgcccgcgaggtggcccccaggctggcctttgccagcatgttcaacagctcggagcagtcccagaaggcactttaggaggccaagtcaggaggagcgcatgagcccaggagacctgcctggacaacatagcaagactccatctctacaaaaaatggaaaaaaaaattagcaggtatggcggtgtgtgcttatggtcccagttactcgggaggctaaggtgggaggatcacttgagcccaggaggttgaggctgcagtcagccatgattataccactacactctagcttgggcaacaaagtgagaccctgtcaaaaaaaaaaaaaaaaaa

SEQ ID NO: 5882 - DNA, 646 bp, Artificial Sequence
  Synthetic polypeptide
atgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaaggcactttaggaggccaagtcaggaggagcgcatgagcccaggagtttgagacctgcctgggcaacatagcaagactccatctctacaaaaaacggaaaaaaaaattagctaggtgtggcggtgtgtgcttatgttcccagctacttgggaggctaaggtgggaggatcacttgagcccaggaggttgaggctgcagtgagccatgattgtaccactacactctagcttgggcaacaaagtgagaccctgccaaaaaaaaaaaaaa

SEQ ID NO: 5883 - DNA, 175 bp, Artificial Sequence; identical to SEQ ID NO: 5737
  Synthetic polypeptide

SEQ ID NO: 5884 - DNA, 1166 bp, Artificial Sequence; identical to SEQ ID NO: 3328
  Synthetic polypeptide

SEQ ID NO: 5885 - DNA, 2097 bp, Artificial Sequence
  Synthetic polypeptide
atggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattccacattgcaactcacctttaagaaacttctacgtgtcaagttttgaagtggtatcaaaaaagaatacaattatttgaaaagtctattaaaatatgcctcccttttccaactacttatctgtgggaggttggatttccttcatatacttgaatcacaagacgtatctaaatagactgaatggaaaaacatatatgagaatccagttgaaaattattaagccagacattagatttgcaaaaatgtaagataatactctgcctggtaattttttgttactgttttagaaaatagttatttttcattaaaatactattcattatttatgttaacatgtagcgggtttattacatttaagaaatctattagttttaatttcaaatacagtaaatattgataaatacagcctacataagcaaaagttctttggagtcctcaatgatttttttaagagtgtaaaagggtccctagaccaaaacgtt

SEQ ID NO: 5886 - DNA, 1971 bp, Artificial Sequence
  Synthetic polypeptide
atgattaatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattccacattgcaactcacctttaagaaacttctacgtgtcaagttttgaagtggtatcaaaaaagaatacaattatttgaaaagtctattaaaatatgcctcccttttccaactacttatctgtgggaggttggatttccttcatatacttgaatcacaagacgtatctaaatagactgaatggaaaaacatatatgagaatccagttgaaaattattaagccagacattagatttgcaaaaatgtaagataatactctgcctggtaattttttgttactgttttagaaaatagttatttttcattaaaatactattcattatttatgttaacatgtagcgggtttattacatttaagaaatctattagttttaatttcaaatacagtaaatattgataaatacagcctacataagcaaaagttctttggagtcctcaatgatttttttaagagtgtaaaagggtccctagaccaaaacgtt

SEQ ID NO: 5887 - DNA, 1746 bp, Artificial Sequence
  Synthetic polypeptide
atggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattccacattgcaactcacctttaagaaacttctacgtgtcaagttttgaagtggtatcaaaaaagaatacaattatttgaaaagtctattaaaatatgcctcccttttccaactacttatctgtgggaggttggatttccttcatatacttgaatcacaagacgtatctaaatagactgaatggaaaaacatatatgagaatccagttgaaaattattaagccagacattagatttgcaaaaatgtaagataatactctgcctggtaattttttgttactgttttagaaaatagttatttttcattaaaatactattcattatttatgttaacatgtagcgggtttattacatttaagaaatctattagttttaatttcaaatacagtaaatattgataaatacagcctacataagcaaaagttctttggagtcctcaatgatttttttaagagtgtaaaagggtccctagaccaaaacgtt

SEQ ID NO: 5888 - DNA, 2100 bp, Artificial Sequence
  Synthetic polypeptide
atggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattccacattgcaactcacctttaagaaacttctacgtgtcaagttttgaagtggtatcaaaaaagaatacaattatttgaaaagtctattaaaatatgcctcccttttccaactacttatctgtgggaggttggatttccttcatatacttgaatcacaagacgtatctaaatagactgaatggaaaaacatatatgagaatccagttgaaaattattaagccagacattagatttgcaaaaatgtaagataatactctgcctggtaattttttgttactgttttagaaaatagttatttttcattaaaatactattcattatttatgttaacatgtagcgggtttattacatttaagaaatctattagttttaatttcaaatacagtaaatattgataaatacagcctacataagcaaaagttctttggagtcctcaatgatttttttaagagtgtaaaagggtccctagaccaaaacgtt

SEQ ID NO: 5889 - DNA, 1968 bp, Artificial Sequence
  Synthetic polypeptide
atgattaatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattccacattgcaactcacctttaagaaacttctacgtgtcaagttttgaagtggtatcaaaaaagaatacaattatttgaaaagtctattaaaatatgcctcccttttccaactacttatctgtgggaggttggatttccttcatatacttgaatcacaagacgtatctaaatagactgaatggaaaaacatatatgagaatccagttgaaaattattaagccagacattagatttgcaaaaatgtaagataatactctgcctggtaattttttgttactgttttagaaaatagttatttttcattaaaatactattcattatttatgttaacatgtagcgggtttattacatttaagaaatctattagttttaatttcaaatacagtaaatattgataaatacagcctacataagcaaaagttctttggagtcctcaatgatttttttaagagtgtaaaagggtccctagaccaaaacgtt

SEQ ID NO: 5890 - DNA, 2094 bp, Artificial Sequence
  Synthetic polypeptide
atgagcaaggaggccgtgagcctgtgggcgctcactgtgtccctccaacccccagtccccttgtgtgtctgcagagagatgacaggatcaggcagaagaaaacagcaatgtgtaactttgccattcatctccagagaattatgtttttatcttttgctttttcctccccccaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattccacattgcaactcacctttaagaaacttctacgtgtcaagttttgaagtggtatcaaaaaagaatacaattatttgaaaagtctattaaaatatgcctcccttttccaactacttatctgtgggaggttggatttccttcatatacttgaatcacaagacgtatctaaatagactgaatggaaaaacatatatgagaatccagttgaaaattattaagccagacattagatttgcaaaaatgtaagataatactctgcctggtaattttttgttactgttttagaaaatagttatttttcattaaaatactattcattatttatgttaacatgtagcgggtttattacatttaagaaatctattagttttaatttcaaatacagtaaatattgataaatacagcctacataagcaaaagttctttggagtcctcaatgatttttttaagagtgtaaaagggtccctagaccaaaacgtt

SEQ ID NO: 5891 - DNA, 281 bp, Artificial Sequence; identical to SEQ ID NO: 3151
  Synthetic polypeptide

SEQ ID NO: 5892 - DNA, 312 bp, Artificial Sequence
  Synthetic polypeptide
atgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcggatcaagaagctgtacaaagtgcccgacttcccctcgaaacgcctgcccaactggaggaccagagggttggaacagcgccggcagggcttggaggcttacatccaggtccaaacacccccctctggcttgttgaaaggactgaaagaggtaacg

SEQ ID NO: 5893 - DNA, 652 bp, Artificial Sequence
  Synthetic polypeptide
atgaggcgaccaggtagaaaggggactgggggcggccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggtgttgtggcacatgcctatagtcccagctacttaggatgctgagatgggaggatctcttgactccgggaaatcaaagctgccgtgagctgtgagcatgcccctgcactccaggcgatagagc

SEQ ID NO: 5894 - DNA, 760 bp, Artificial Sequence
  Synthetic polypeptide
atggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggtgttgtggcacatgcctatagtcccagctacttaggatgctgagatgggaggatctcttgactccgggaaatcaaagctgccgtgagctgtgagcatgcccctgcactccaggcgatagagc

SEQ ID NO: 5895 - DNA, 1410 bp, Artificial Sequence
  Synthetic polypeptide
atgcaggcgggcgccaggttccagcggcggcggcggcagctgcagcagcagcagccccggcggcggcagcctctcctctggccgatggacgcagagccgccgccgccgccgccctgggtctggatggtgccgggctcggccgggctgctccggctcagcgcgggggtcgtggttcccccggtgctgctcgcctcggccccgccgcccgcggccccgctgctccccggtctccccggctggccggccccgagcgagccggtgctcccgctgctgccgctgccctctgcgccagactccgccgccgccgccgccgcgcaccccttccccgcgctccacgggcagtggctgtttggtggccattctccgtccctaggactgcccccctcttccacagtggagctggtgcccgtcttcccacatctctgcccttctgctcttgcaacccctattgggaaaagttggatagacaaaaggattcctaactgtaagatcttttttaataattcctttgctctggactcaacgtggatacatcctgaggagtcaaggtttttccatgggcatgaaaagcctcgtttgctggcaaatcaagtagctgtgtctctgtccaggccggctcctgcctccaggccgctccccacggtggtgttagcacctcagcccatcccaggggtttcaagacgtctttggaggaagtaactgctgatgtggtggaaacagcaagagaactagaagtggaagtggagcttgaagatgtgactgaattgctgaaatctcaaatacaactttaacgcataaggagttacttcttacgagtgaacatagaaagtggtttcttgagatggaatctactcctggtgaagatgttgtaaacattgttgaaataataacaaaggatttagaatattacatagactgagttgataaagcagcagcagggtttgaggggattgactccaattttgaaagttctactgcggctaaaatgctgtcaaacagcattgcatgctacagagacatctttcctgaaaggaagagtccatcaatgtagcaagcgttgctgttgtcttcttttgtgaaattggcacagccaccccagccttcagcaaccaccatcctgatcagtcagcggccatcaacatcgaggcaagaccctccactggcaaaagagttacagtttgctgaaggctcagatgatctctaatattttttagcaataaactatttttaaatttagggatgtacattttttagacataatactattgcacatttaacagactacactatagtgtaaacataacttttgtatgcattggaaaaccaaaaaattcacttgactctctttatcgcaatatttgcgttattgtggtggtctggtactgaacccacgttatctctgaggtttgc

SEQ ID NO: 5896 - DNA, 655 bp, Artificial Sequence
  Synthetic polypeptide
atggcggccaccgggaccgcggccgccgcagccacgggcaggctcctgcttctgctgctggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcggcgcagtggctcacgcctgtaatcccaacacttggggaggccgaggccggggtggatcacaaggtcagtagatcgagaccatcctggctaacatggtgaaaacccgtctctctactaaaaatacaaaaaaattagacgggcgtggtggcacgtgcctgtagtcccagctacttgggaggctgaggcaggagaatcacttgaacccgggaggcagagtttgtagtgagctgagattgcgccactgcactccagcctgggcagcagagcgagactccatctcaaaaaaaaaaaaaaaaa

SEQ ID NO: 5897 - DNA, 700 bp, Artificial Sequence
  Synthetic polypeptide
atggcggccaccgggaccgcggccgccgcagccacgggcaggctcctgcttctgctgctggtggggctcacggcgcctgccttggcgctggccggctacatcgaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcggcgcagtggctcacgcctgtaatcccaacacttggggaggccgaggccggggtggatcacaaggtcagtagatcgagaccatcctggctaacatggtgaaaacccgtctctctactaaaaatacaaaaaaattagacgggcgtggtggcacgtgcctgtagtcccagctacttgggaggctgaggcaggagaatcacttgaacccgggaggcagagtttgtagtgagctgagattgcgccactgcactccagcctgggcagcagagcgagactccatctcaaaaaaaaaaaaaaaaa

SEQ ID NO: 5898 - DNA, 730 bp, Artificial Sequence
  Synthetic polypeptide
atgctgcgagccccgggggagctcccgcgccaggccgcccgctgctccctctgccgcctggggccgggtcgcggacgcgcattttttaagtggcgctgtttgcctgcgtccgtagaccgaggaaacccgctctgggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcggcgcagtggctcacgcctgtaatcccaacacttggggaggccgaggccggggtggatcacaaggtcagtagatcgagaccatcctggctaacatggtgaaaacccgtctctctactaaaaatacaaaaaaattagacgggcgtggtggcacgtgcctgtagtcccagctacttgggaggctgaggcaggagaatcacttgaacccgggaggcagagtttgtagtgagctgagattgcgccactgcactccagcctgggcagcagagcgagactccatctcaaaaaaaaaaaaaaaaa

SEQ ID NO: 5899 - DNA, 421 bp, Artificial Sequence
  Synthetic polypeptide
atgtatccagagctacagatcacaaatgtgatggaggcaaaccagcgggttagtattgacaactggtgccggagggacaaaaagcaatgcaagagtcgctttgttacacctttcaagtgtctcggcgcagtggctcacgcctgtaatcccaacacttggggaggccgaggccggggtggatcacaaggtcagtagatcgagaccatcctggctaacatggtgaaaacccgtctctctactaaaaatacaaaaaaattagacgggcgtggtggcacgtgcctgtagtcccagctacttgggaggctgaggcaggagaatcacttgaacccgggaggcagagtttgtagtgagctgagattgcgccactgcactccagcctgggcagcagagcgagactccatctcaaaaaaaaaaaaaaaaa

SEQ ID NO: 5900 - DNA, 15330 bp, Artificial Sequence; identical to SEQ ID NO: 1467
  Synthetic polypeptide

SEQ ID NO: 5901 - DNA, 15330 bp, Artificial Sequence; identical to SEQ ID NO: 1468
  Synthetic polypeptide

SEQ ID NO: 5902 - DNA, 15345 bp, Artificial Sequence; identical to SEQ ID NO: 1469
  Synthetic polypeptide

SEQ ID NO: 5903 - DNA, 3012 bp, Artificial Sequence
  Synthetic polypeptide
atggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgaacttgtttggaacttgtcataaaatcgatcagtttggtgaattgcaaccaacaatatttaaaaagaaaacagaacagaacaaaatatcaggatgcaatgtgcatggtatgaaagtatcatttcattcatcttagttcatgcttgcatgtgagtgggtgtgtgtttgcataagtgttggttcacaacataaaatgtaattcttatttagggttgtagacaaaa

SEQ ID NO: 5904 - DNA, 776 bp, Artificial Sequence; identical to SEQ ID NO: 131
  Synthetic polypeptide

SEQ ID NO: 5905 - DNA, 737 bp, Artificial Sequence; identical to SEQ ID NO: 132
  Synthetic polypeptide

SEQ ID NO: 5906 - DNA, 3665 bp, Artificial Sequence; identical to SEQ ID NO: 2970
  Synthetic polypeptide

SEQ ID NO: 5907 - DNA, 3377 bp, Artificial Sequence; identical to SEQ ID NO: 2971
  Synthetic polypeptide

SEQ ID NO: 5908 - DNA, 2243 bp, Artificial Sequence; identical to SEQ ID NO: 2972
  Synthetic polypeptide

SEQ ID NO: 5909 - DNA, 877 bp, Artificial Sequence
  Synthetic polypeptide
atgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgggacgtcaccagacttccc

SEQ ID NO: 5910 - DNA, 353 bp, Artificial Sequence
  Synthetic polypeptide
atgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcggacttcaggggccgggcgcgctggctcacacctgtaatcctagcactttgggggccgggcgcggtcgcgcacacctgtaatcctagcactttgggggccggg

SEQ ID NO: 5911 - DNA, 179 bp, Artificial Sequence
  Synthetic polypeptide
gcgctgctgaacgctttcaccgcaacttttgagctaagtgatgatggccgctttgaggtgtggaatgcgatgactcggacttcaggggccgggcgcgctggctcacacctgtaatcctagcactttgggggccgggcgcggtcgcgcacacctgtaatcctagcactttgggggccggg

SEQ ID NO: 5912 - DNA, 155 bp, Artificial Sequence
  Synthetic polypeptide
acttttgagctaagtgatgatggccgctttgaggtgtggaatgcgatgactcggacttcaggggccgggcgcgctggctcacacctgtaatcctagcactttgggggccgggcgcggtcgcgcacacctgtaatcctagcactttgggggccggg

SEQ ID NO: 5913 - DNA, 3727 bp, Artificial Sequence; identical to SEQ ID NO: 2946
  Synthetic polypeptide

SEQ ID NO: 5914 - DNA, 3439 bp, Artificial Sequence; identical to SEQ ID NO: 2947
  Synthetic polypeptide

SEQ ID NO: 5915 - DNA, 2305 bp, Artificial Sequence; identical to SEQ ID NO: 2948
  Synthetic polypeptide

SEQ ID NO: 5916 - DNA, 1781 bp, Artificial Sequence
  Synthetic polypeptide
atgcaggcgggcgccaggttccagcggcggcggcggcagctgcagcagcagcagccccggcggcggcagcctctcctctggccgatggacgcagagccgccgccgccgccgccctgggtctggatggtgccgggctcggccgggctgctccggctcagcgcgggggtcgtggttcccccggtgctgctcgcctcggccccgccgcccgcggccccgctgctccccggtctccccggctggccggccccgagcgagccggtgctcccgctgctgccgctgccctctgcgccagactccgccgccgccgccgccgcgcaccccttccccgcgctccacgggcagtggctgtttggtggccattctccgtccctaggactgcccccctcttccacagtggagctggtgcccgtcttcccacatctctgcccttctgctcttgcaacccctattgggaaaagttggatagacaaaaggattcctaactgtaagatcttttttaataattcctttgctctggactcaacgtggatacatcctgaggagtcaaggtttttccatgggcatgaaaagcctcgtttgctggcaaatcaagtagctgtgtctctgtccaggccggctcctgcctccaggccgctccccacggtggtgttagcacctcagcccatcccaggtggctgccataacagccttaaggtgaccagcagccccgccattgccatcgccaccgccgccgccgctgccatggtctccgtggaccctgagaacctccggggcccgtccccctccagcgtgcagccgcgccacttcctgaccttggcacccatcaaaatacccctccggacgtcccccgtctcagatacaaggacagagcggggccgagtggcccgccctcctgccctgatgctgcgggcccagaagagccgggatggagacaaagaagacaaggagcctccaccgatgctggggggaggagaggacagcacagccagaggcaacaggccagtggcctccaccccggtgcccggatccccctggtgtgtggtctggacgggcgatgaccgagttttcttcttcaacccaacgatgcacctgtctgtctgggagaagcccatggacctgaaggaccgcggagacctcaacaggatcattgaggacccgccccacaaacgcaagctggaggcaccagcaactgacaacagcgatgggtccagttctgaagacaacagggaagaccaagatgtgaaaaccaagaggaaccggaccgaaggctgcgggagtcccaagccagaggaggcaaagagagaggacaaaggcacaaggacgccgcccccgcagatcctcctgcctctggaggagcgtgtgacccacttccgagacatgctgctggagagaggggctatttacgaggaaaacctcagacaaatcccaactgaggagtgtcctgcaatgcacctgaccagggctcctcaaaccatcaaggtcatcaacggcaagggccatctgagaccctgtcacagccaagaggagtccaaggagatatggcagcgaaatgtgatgaggtccttggcagaaatggaaaattgggtaaaacctaaagaaatctgaataaatgcagactattgttagtaataatgcgtcatggttagtggtgacgaatctagcctactaatatgttaacgacgtgagaaactgggtatgagtatatggtaactttctgtaatattcttgcaaatttttagtacgtctaaaactattgcaaacaaaataatttatttttaaaa

SEQ ID NO: 5917 - DNA, 1789 bp, Artificial Sequence; identical to SEQ ID NO: 4563
  Synthetic polypeptide

SEQ ID NO: 5918 - DNA, 553 bp, Artificial Sequence; identical to SEQ ID NO: 4564
  Synthetic polypeptide

SEQ ID NO: 5919 - DNA, 1807 bp, Artificial Sequence; identical to SEQ ID NO: 4565
  Synthetic polypeptide

SEQ ID NO: 5920 - DNA, 1637 bp, Artificial Sequence
  Synthetic polypeptide
atgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagggtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaac

SEQ ID NO: 5921 - DNA, 1358 bp, Artificial Sequence
  Synthetic polypeptide
atgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagggtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaac

SEQ ID NO: 5922 - DNA, 1119 bp, Artificial Sequence
  Synthetic polypeptide
atcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctccatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagggtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaac

SEQ ID NO: 5923 - DNA, 1239 bp, Artificial Sequence; identical to SEQ ID NO: 129
  Synthetic polypeptide

SEQ ID NO: 5924 - DNA, 1200 bp, Artificial Sequence; identical to SEQ ID NO: 130
  Synthetic polypeptide

SEQ ID NO: 5925 - DNA, 2501 bp, Artificial Sequence; identical to SEQ ID NO: 1164
  Synthetic polypeptide

SEQ ID NO: 5926 - DNA, 2552 bp, Artificial Sequence; identical to SEQ ID NO: 1165
  Synthetic polypeptide

SEQ ID NO: 5927 - DNA, 2456 bp, Artificial Sequence; identical to SEQ ID NO: 1166
  Synthetic polypeptide

SEQ ID NO: 5928 - DNA, 588 bp, Artificial Sequence; identical to SEQ ID NO: 1167
  Synthetic polypeptide

SEQ ID NO: 5929 - DNA, 861 bp, Artificial Sequence
  Synthetic polypeptide
atgcggctgctggcactggcggcggccgcgctgctggcgcgggctccggctccggaggtctgtgcggccctcaatgtcactgtgtccccggggcccgtggttgactacctggagggggagaatgccactctcctctgccacgtctcccagaaaaggcggaaggacagcttgctggccgtgcgctggttctttgcacactccttcgactcccaggaggccttgatggtgaagatgaccaagctccgggtggtgcagtactatgggaatttcagccgcagcgccaaacggcggaggctgcgcctgctggaggagcagcggggggcgctctacaggctctccgtcttgacactgcagccctccgatcaagggcattacgtctgcagagtccaggaaatcagcaggcacaggaacaagtggacggcctggtccaatggctcctcagccacggaaatgagagtcatttccctcaaagcttctgaagagtcatcctttgagaaaacaaaagagacttgggcattttttgaagatctctatgtgtatgctgtcctcgtgtgctgcgtggggatcctcagcattctgctcttcatgctggtcatcgtctggcagtctgtgtttaacaagcggaaatccagagtgagacattatttggtgaaatgccctcagaacagctcaggggagactgtcactagcgtgaccagcttggccccactacagcccaagaagggcaagaggcagaaggagaagcctgacattcctcccgcagtccctgccaaagctccgatagcccccacgttccataaaccgaagctgctgaaaccacagagaaaagtcacgctgcctgttgtcaacatttatccacac

SEQ ID NO: 5930 - DNA, 858 bp, Artificial Sequence; identical to SEQ ID NO: 4891
  Synthetic polypeptide

SEQ ID NO: 5931 - DNA, 340 bp, Artificial Sequence; identical to SEQ ID NO: 4892
  Synthetic polypeptide

SEQ ID NO: 5932 - DNA, 657 bp, Artificial Sequence; identical to SEQ ID NO: 180
  Synthetic polypeptide

SEQ ID NO: 5933 - DNA, 423 bp, Artificial Sequence; identical to SEQ ID NO: 179
  Synthetic polypeptide

SEQ ID NO: 5934 - DNA, 3308 bp, Artificial Sequence; identical to SEQ ID NO: 428
  Synthetic polypeptide

SEQ ID NO: 5935 - DNA, 3203 bp, Artificial Sequence; identical to SEQ ID NO: 429
  Synthetic polypeptide

SEQ ID NO: 5936 - DNA, 2849 bp, Artificial Sequence; identical to SEQ ID NO: 430
  Synthetic polypeptide

SEQ ID NO: 5937 - DNA, 388 bp, Artificial Sequence; identical to SEQ ID NO: 431
  Synthetic polypeptide

SEQ ID NO: 5938 - DNA, 321 bp, Artificial Sequence; identical to SEQ ID NO: 1173
  Synthetic polypeptide

SEQ ID NO: 5939 - DNA, 267 bp, Artificial Sequence; identical to SEQ ID NO: 1174
  Synthetic polypeptide

SEQ ID NO: 5940 - DNA, 238 bp, Artificial Sequence; identical to SEQ ID NO: 1175
  Synthetic polypeptide

SEQ ID NO: 5941 - DNA, 495 bp, Artificial Sequence; identical to SEQ ID NO: 5854
  Synthetic polypeptide

SEQ ID NO: 5942 - DNA, 270 bp, Artificial Sequence; identical to SEQ ID NO: 5855
  Synthetic polypeptide

SEQ ID NO: 5943 - DNA, 445 bp, Artificial Sequence
  Synthetic polypeptide
atgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtagg

SEQ ID NO: 5944 - DNA, 381 bp, Artificial Sequence; identical to SEQ ID NO: 201
  Synthetic polypeptide

SEQ ID NO: 5945 - DNA, 732 bp, Artificial Sequence
  Synthetic polypeptide
atgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagacttgtcaaatcagaatctct

SEQ ID NO: 5946 - DNA, 1386 bp, Artificial Sequence
  Synthetic polypeptide
atggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccgcccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagacttgtcaaatcagaatctct

SEQ ID NO: 5947 - DNA, 1191 bp, Artificial Sequence
  Synthetic polypeptide
atggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcaggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccgcccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagacttgtcaaatcagaatctct

SEQ ID NO: 5948 - DNA, 137 bp, Artificial Sequence; identical to SEQ ID NO: 336
  Synthetic polypeptide

SEQ ID NO: 5949 - DNA, 976 bp, Artificial Sequence; identical to SEQ ID NO: 2334
  Synthetic polypeptide

SEQ ID NO: 5950 - DNA, 1009 bp, Artificial Sequence; identical to SEQ ID NO: 2335
  Synthetic polypeptide

SEQ ID NO: 5951 - DNA, 1132 bp, Artificial Sequence; identical to SEQ ID NO: 2336
  Synthetic polypeptide

SEQ ID NO: 5952 - DNA, 563 bp, Artificial Sequence; identical to SEQ ID NO: 2337
  Synthetic polypeptide

SEQ ID NO: 5953 - DNA, 1917 bp, Artificial Sequence
  Synthetic polypeptide
atggaagcagaaacagggagcagcgtggagactggaaagaaggccaacagaggcactcgaattgccctggtcgtgtttgtcggtggcaccctagttctgggcacgatcctctttctagtgagtcaaggtctcttaagtctccaagctaaacaggagtactgcctgaagccagaatgcatcgaagcggctgctgccatcttaagtaaagtaaatctgtctgtggatccttgtgataatttcttccggttcgcttgtgatggctggataagcaataatccaattcccgaagatatgccaagctatggggtttatccttggctgagacataatgttgacctcaagttgaaggaacttttggagaaatcaatcagtagaaggcgggacaccgaagccatacagaaagccaaaatcctttattcatcctgcatgaatgagaaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaagctggaccaagcaacactctccctggccgtgagggaagactaccttgataacagtacagaagccaagtcttatcgggatgccctttacaagttcatggtggatactgccgtgcttttaggagctaacagttccagagcagagcatgacatgaagtcagtgctcagattggaaattaagatagctgagataatgattccacatgaaaaccgaaccagcgaggccatgtacaacaaaatgaacatttctgaactgagtgctatgattccccagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagaccattgccaactatttggtgtggagaatggtttattccagaattccaaaccttagcaggcgctttcagtatagatggctggaattctcaagggtaatccaggggaccacaactttgctgcctcaatgggacaaatgtgtaaactttattgaaagtgccctcccttatgttgttggaaagatgtttgtagatgtgtacttccaggaagataagaaggaaatgatggaggaattggttgagggcgttcgctgggcctttattgacatgctagagaaagaaaatgagtggatggatgcaggaacgaaaaggaaagccaaagaaaaggcgagagctgttttggcaaaagttggctatccagagtttataatgaatgatactcatgttaatgaagacctcaaagctatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgaagatgagtcacatgtggcatattcacacaaaggaataccatacagcagtgaaaaatgagcaacatatattaacatggatgaatttcacaagtaaaacaacttgggaaaatatatcaagtatgatactatataaataaagttgaaaatcatgcagaacaattctacacatggtttggaggtccatccatttgtagtgtaagtgtaaagacattcatgagaatgacaaacaccaaattccggttggtggtggcttgtcttggggagggtggg

SEQ ID NO: 5954 - DNA, 1626 bp, Artificial Sequence
  Synthetic polypeptide
atgccaagctatggggtttatccttggctgagacataatgttgacctcaagttgaaggaacttttggagaaatcaatcagtagaaggcgggacaccgaagccatacagaaagccaaaatcctttattcatcctgcatgaatgagaaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaagctggaccaagcaacactctccctggccgtgagggaagactaccttgataacagtacagaagccaagtcttatcgggatgccctttacaagttcatggtggatactgccgtgcttttaggagctaacagttccagagcagagcatgacatgaagtcagtgctcagattggaaattaagatagctgagataatgattccacatgaaaaccgaaccagcgaggccatgtacaacaaaatgaacatttctgaactgagtgctatgattccccagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagaccattgccaactatttggtgtggagaatggtttattccagaattccaaaccttagcaggcgctttcagtatagatggctggaattctcaagggtaatccaggggaccacaactttgctgcctcaatgggacaaatgtgtaaactttattgaaagtgccctcccttatgttgttggaaagatgtttgtagatgtgtacttccaggaagataagaaggaaatgatggaggaattggttgagggcgttcgctgggcctttattgacatgctagagaaagaaaatgagtggatggatgcaggaacgaaaaggaaagccaaagaaaaggcgagagctgttttggcaaaagttggctatccagagtttataatgaatgatactcatgttaatgaagacctcaaagctatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgaagatgagtcacatgtggcatattcacacaaaggaataccatacagcagtgaaaaatgagcaacatatattaacatggatgaatttcacaagtaaaacaacttgggaaaatatatcaagtatgatactatataaataaagttgaaaatcatgcagaacaattctacacatggtttggaggtccatccatttgtagtgtaagtgtaaagacattcatgagaatgacaaacaccaaattccggttggtggtggcttgtcttggggagggtggg

SEQ ID NO: 5955 - DNA, 1026 bp, Artificial Sequence
  Synthetic polypeptide
atgatccacctgcctcggcctcccaaagtgctgggattacagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagaccattgccaactatttggtgtggagaatggtttattccagaattccaaaccttagcaggcgctttcagtatagatggctggaattctcaagggtaatccaggggaccacaactttgctgcctcaatgggacaaatgtgtaaactttattgaaagtgccctcccttatgttgttggaaagatgtttgtagatgtgtacttccaggaagataagaaggaaatgatggaggaattggttgagggcgttcgctgggcctttattgacatgctagagaaagaaaatgagtggatggatgcaggaacgaaaaggaaagccaaagaaaaggcgagagctgttttggcaaaagttggctatccagagtttataatgaatgatactcatgttaatgaagacctcaaagctatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgaagatgagtcacatgtggcatattcacacaaaggaataccatacagcagtgaaaaatgagcaacatatattaacatggatgaatttcacaagtaaaacaacttgggaaaatatatcaagtatgatactatataaataaagttgaaaatcatgcagaacaattctacacatggtttggaggtccatccatttgtagtgtaagtgtaaagacattcatgagaatgacaaacaccaaattccggttggtggtggcttgtcttggggagggtggg

SEQ ID NO: 5956 - DNA, 12492 bp, Artificial Sequence; identical to SEQ ID NO: 3203
  Synthetic polypeptide

SEQ ID NO: 5957 - DNA, 12567 bp, Artificial Sequence; identical to SEQ ID NO: 3204
  Synthetic polypeptide

SEQ ID NO: 5958 - DNA, 9032 bp, Artificial Sequence; identical to SEQ ID NO: 3205
  Synthetic polypeptide

SEQ ID NO: 5959 - DNA, 561 bp, Artificial Sequence; identical to SEQ ID NO: 3206
  Synthetic polypeptide

SEQ ID NO: 5960 - DNA, 134 bp, Artificial Sequence
  Synthetic polypeptide
atgcgctacgtcgcctcctacctgctggctgccctagggggcaactcctcccccagcgccaaggacatcaagaagatcttggacagcgtgggtatcgaggcggacgacgaccggctcaacaaggaagtcgaggc

SEQ ID NO: 5961 - DNA, 1061 bp, Artificial Sequence; identical to SEQ ID NO: 4766
  Synthetic polypeptide

SEQ ID NO: 5962 - DNA, 1058 bp, Artificial Sequence; identical to SEQ ID NO: 4767
  Synthetic polypeptide

SEQ ID NO: 5963 - DNA, 1031 bp, Artificial Sequence; identical to SEQ ID NO: 4768
  Synthetic polypeptide

SEQ ID NO: 5964 - DNA, 2818 bp, Artificial Sequence
  Synthetic polypeptide
atgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacagatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctggtggagttttcctgcacaagctctctttgcttgctgccatccatgtaagatgtgacttgctcctccttgccttccaccatgattgtgaggctaccccagccacatggaactgtaagtccaattaaacctctttcttttctaaattgcccagtcttgagtatgtctttatcagcagcacgaaaacag

SEQ ID NO: 5965 - DNA, 2698 bp, Artificial Sequence
  Synthetic polypeptide
atgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgagcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctggtggagttttcctgcacaagctctctttgcttgctgccatccatgtaagatgtgacttgctcctccttgccttccaccatgattgtgaggctaccccagccacatggaactgtaagtccaattaaacctctttcttttctaaattgcccagtcttgagtatgtctttatcagcagcacgaaaacag

SEQ ID NO: 5966 - DNA, 2713 bp, Artificial Sequence
  Synthetic polypeptide
atgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgagtctgaatgttttaggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctggtggagttttcctgcacaagctctctttgcttgctgccatccatgtaagatgtgacttgctcctccttgccttccaccatgattgtgaggctaccccagccacatggaactgtaagtccaattaaacctctttcttttctaaattgcccagtcttgagtatgtctttatcagcagcacgaaaacag

SEQ ID NO: 5967 - DNA, 2803 bp, Artificial Sequence
  Synthetic polypeptide
atgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacaggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctggtggagttttcctgcacaagctctctttgcttgctgccatccatgtaagatgtgacttgctcctccttgccttccaccatgattgtgaggctaccccagccacatggaactgtaagtccaattaaacctctttcttttctaaattgcccagtcttgagtatgtctttatcagcagcacgaaaacag

SEQ ID NO: 5968 - DNA, 2713 bp, Artificial Sequence
  Synthetic polypeptide
atgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgaatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctggtggagttttcctgcacaagctctctttgcttgctgccatccatgtaagatgtgacttgctcctccttgccttccaccatgattgtgaggctaccccagccacatggaactgtaagtccaattaaacctctttcttttctaaattgcccagtcttgagtatgtctttatcagcagcacgaaaacag

SEQ ID NO: 5969 - DNA, 1517 bp, Artificial Sequence
  Synthetic polypeptide
tgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacagatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctggtggagttttcctgcacaagctctctttgcttgctgccatccatgtaagatgtgacttgctcctccttgccttccaccatgattgtgaggctaccccagccacatggaactgtaagtccaattaaacctctttcttttctaaattgcccagtcttgagtatgtctttatcagcagcacgaaaacag

SEQ ID NO: 5970 - DNA, 3525 bp, Artificial Sequence; identical to SEQ ID NO: 214
  Synthetic polypeptide

SEQ ID NO: 5971 - DNA, 1654 bp, Artificial Sequence; identical to SEQ ID NO: 1385
  Synthetic polypeptide

SEQ ID NO: 5972 - DNA, 632 bp, Artificial Sequence; identical to SEQ ID NO: 1386
  Synthetic polypeptide

SEQ ID NO: 5973 - DNA, 1357 bp, Artificial Sequence
  Synthetic polypeptide
atggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgactggacattaccctgaattctactagttcctccaattccatcttctcccatggaacctcaaagagcaagacccactctgttccagaagccctataagccagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacacgtggacagtttttcccaagatgtcagaataagactccccatcatgatgaggctctcacccctcttagctgtccttgcttgtgcctgcctctttcacttggcaggataatgcagtcattagaatttcacatgtagtagcttctgagggtaac

SEQ ID NO: 5974 - DNA, 1636 bp, Artificial Sequence
  Synthetic polypeptide
atggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctggaaactcccaagccctccatctccagtagcaacttaaaccccagggaggccatggaggctgtgatcttaacctgtgatcctgcggcttcagacacaagctacctgtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccacagtgacccagtcaccctgaatctcctcctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgactggacattaccctgaattctactagttcctccaattccatcttctcccatggaacctcaaagagcaagacccactctgttccagaagccctataagccagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacacgtggacagtttttcccaagatgtcagaataagactccccatcatgatgaggctctcacccctcttagctgtccttgcttgtgcctgcctctttcacttggcaggataatgcagtcattagaatttcacatgtagtagcttctgagggtaac

SEQ ID NO: 5975 - DNA, 1151 bp, Artificial Sequence
  Synthetic polypeptide
atgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggactcaatcactaagtgaccttccagctccaccatcgatga

SEQ ID NO: 5976 - DNA, 1358 bp, Artificial Sequence
  Synthetic polypeptide
atggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgactggacattaccctgaattctactagttcctccaattccattttctcccatggaatcactaagaccaagacccactctgttccagaagccctataagtgggaggaggacaactcaatgtaaatttcatgggaaaattcttgtacctgaagtgtgagccactcagaactcaccaaaatgttggacagcataacaacagatgctcaaactgtaaaccaggacaacaagttgatgacttcacactgtggacagttctccccaagatgtcaaaataagactccccatcatgatgaggctctcgcccctcttaactgtccttgctcatgcatgcctctttcatttggcaggataatgcagtcattagaatttcacatgtagtagcttctgagggtaac

SEQ ID NO: 5977 - DNA, 1637 bp, Artificial Sequence
  Synthetic polypeptide
atggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctggaaactcccaagccctccatctccagtagcaacttaaaccccagggaggccatggaggctgtgatcttaacctgtgatcctgcggcttcagacacaagctacctgtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccacagtgacccagtcaccctgaatctcctcctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgactggacattaccctgaattctactagttcctccaattccattttctcccatggaatcactaagaccaagacccactctgttccagaagccctataagtgggaggaggacaactcaatgtaaatttcatgggaaaattcttgtacctgaagtgtgagccactcagaactcaccaaaatgttggacagcataacaacagatgctcaaactgtaaaccaggacaacaagttgatgacttcacactgtggacagttctccccaagatgtcaaaataagactccccatcatgatgaggctctcgcccctcttaactgtccttgctcatgcatgcctctttcatttggcaggataatgcagtcattagaatttcacatgtagtagcttctgagggtaac

SEQ ID NO: 5978 - DNA, 1363 bp, Artificial Sequence
  Synthetic polypeptide
atggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgactggacattaccctgaattctactagttcctccaattccatcttctcccatggaacctcaaagagcaagacccactctgttccagaagccctataagtcagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacactgtggacagcttttcccaagatgtcagaataagactccccatcatgatgaggctctcacccctcttagctgtccttgcttgtgcctgcctctttcacttggcaggataatgcagtcattagaatttcacatgtagtataggagcttctgagggtaac

SEQ ID NO: 5979 - DNA, 1642 bp, Artificial Sequence
  Synthetic polypeptide
atggggcccctctcagcccctccctgcacacagcacatcacctggaaggggctcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctggaaactcccaagccctccatctccagtagcaacttaaaccccagggaggccatggaggctgtgatcttaacctgtgatcctgcggcttcagacacaagctacctgtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccacagtgacccagtcaccctgaatctcctcctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatgaatgtgaaatacgggaccgagatggtggcatgcgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagctactggcaaggaaagctccaaatccatgacagtcgaagtctctgactggacattaccctgaattctactagttcctccaattccatcttctcccatggaacctcaaagagcaagacccactctgttccagaagccctataagtcagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacactgtggacagcttttcccaagatgtcagaataagactccccatcatgatgaggctctcacccctcttagctgtccttgcttgtgcctgcctctttcacttggcaggataatgcagtcattagaatttcacatgtagtataggagcttctgagggtaac

SEQ ID NO: 5980 - DNA, 500 bp, Artificial Sequence
  Synthetic polypeptide
atgtatataagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgcctggaagaaggagttgaaggagctagcttcccgggtggccttcctcaccaaggaggatgaactgaagaagaaagaggatactaccagtcttaattggaattg

SEQ ID NO: 5981 - DNA, 533 bp, Artificial Sequence
  Synthetic polypeptide
atggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgaagcctggaagaaggagttgaaggagctagcttcccgggtggccttcctcaccaaggaggatgaactgaagaagaaagaggatactaccagtcttaattggaattg

SEQ ID NO: 5982 - DNA, 1038 bp, Artificial Sequence
  Synthetic polypeptide
atgctgctcctgttcctcctcttcgagggtctctgctgtcctggggaaaatacagcagaccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5983 - DNA, 1335 bp, Artificial Sequence
  Synthetic polypeptide
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5984 - DNA, 768 bp, Artificial Sequence
  Synthetic polypeptide
atgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5985 - DNA, 1065 bp, Artificial Sequence
  Synthetic polypeptide
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaattgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5986 - DNA, 603 bp, Artificial Sequence
  Synthetic polypeptide
atgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5987 - DNA, 732 bp, Artificial Sequence
  Synthetic polypeptide
atgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5988 - DNA, 1134 bp, Artificial Sequence
  Synthetic polypeptide
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5989 - DNA, 864 bp, Artificial Sequence
  Synthetic polypeptide
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaattgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5990 - DNA, 1029 bp, Artificial Sequence
  Synthetic polypeptide
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaattgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5991 - DNA, 567 bp, Artificial Sequence
  Synthetic polypeptide
atgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5992 - DNA, 1299 bp, Artificial Sequence
  Synthetic polypeptide
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctgggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattc

SEQ ID NO: 5993 - DNA, 649 bp, Artificial Sequence; identical to SEQ ID NO: 1872
  Synthetic polypeptide

SEQ ID NO: 5994 - DNA, 559 bp, Artificial Sequence; identical to SEQ ID NO: 1873
  Synthetic polypeptide

SEQ ID NO: 5995 - DNA, 109 bp, Artificial Sequence; identical to SEQ ID NO: 1874
  Synthetic polypeptide

SEQ ID NO: 5996 - DNA, 1110 bp, Artificial Sequence; identical to SEQ ID NO: 5164
  Synthetic polypeptide

SEQ ID NO: 5997 - DNA, 1026 bp, Artificial Sequence; identical to SEQ ID NO: 5165
  Synthetic polypeptide

SEQ ID NO: 5998 - DNA, 822 bp, Artificial Sequence; identical to SEQ ID NO: 5166
  Synthetic polypeptide

SEQ ID NO: 5999 - DNA, 757 bp, Artificial Sequence; identical to SEQ ID NO: 1859
  Synthetic polypeptide

SEQ ID NO: 6000 - DNA, 817 bp, Artificial Sequence; identical to SEQ ID NO: 1860
  Synthetic polypeptide

SEQ ID NO: 6001 - DNA, 459 bp, Artificial Sequence
  Synthetic polypeptide
atggccggtacatggctgctacttctcctggcccttgggtgtccagccctacccacaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcagggattatctcaattttgtcatctttcaaatgggaatgtttgttaactaagtgccctgacttccaaagaatgctgcgaaga

SEQ ID NO: 6002 - DNA, 384 bp, Artificial Sequence
  Synthetic polypeptide
atggccggtacatggctgctacttctcctggcccttgggtgtccagccctacccacaggtcctgtttccttcccttcctcaccagaggctgccacaacaggccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcagggattatctcaattttgtcatctttcaaatgggaatgtttgttaactaagtgccctgacttccaaagaatgctgcgaaga

SEQ ID NO: 6003 - DNA, 890 bp, Artificial Sequence
  Synthetic polypeptide
atggaagctgttgccaagtttgatttcactgcttcaggtgaggatgaactgagctttcacactggagatgttttgaagattttaagtaaccaagaggagtggtttaaggcggagcttgggagccaggaaggatatgtgcccaagaatttcatagacatccagtttcccaagcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcaggggcaatgtggagaggtggaaaagtcacaagctttgagtcagaaacacgtgggctgcagtccagactctgctacttacgctatcagcctggacaagtttcttgaccactctgagctgatctagagaactggggataatagcactgagttgtcatgagaagtaaacaaaattataggaactacttggtaagaacctagca

SEQ ID NO: 6004 - DNA, 1010 bp, Artificial Sequence
  Synthetic polypeptide
atggaagctgttgccaagtttgatttcactgcttcaggtgaggatgaactgagctttcacactggagatgttttgaagattttaagtaaccaagaggagtggtttaaggcggagcttgggagccaggaaggatatgtgcccaagaatttcatagacatccagtttcccaaatggtttcacgaaggcctctctcgacaccaggcagagaacttactcatgggcaaggaggttggcttcttcatcatccgggccagccagagctccccaggggacttctccatctctgtcaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcaggggcaatgtggagaggtggaaaagtcacaagctttgagtcagaaacacgtgggctgcagtccagactctgctacttacgctatcagcctggacaagtttcttgaccactctgagctgatctagagaactggggataatagcactgagttgtcatgagaagtaaacaaaattataggaactacttggtaagaacctagca

SEQ ID NO: 6005 - DNA, 812 bp, Artificial Sequence
  Synthetic polypeptide
atgcttgaatttgtctcccttcttgccagaaaggattctaataactcggtgtcaaagccaagacataaactcaaccccttctcttccaaaaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcaggggcaatgtggagaggtggaaaagtcacaagctttgagtcagaaacacgtgggctgcagtccagactctgctacttacgctatcagcctggacaagtttcttgaccactctgagctgatctagagaactggggataatagcactgagttgtcatgagaagtaaacaaaattataggaactacttggtaagaacctagca

SEQ ID NO: 6006 - DNA, 794 bp, Artificial Sequence
  Synthetic polypeptide
atgggcaaggaggttggcttcttcatcatccgggccagccagagctccccaggggacttctccatctctgtcaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcaggggcaatgtggagaggtggaaaagtcacaagctttgagtcagaaacacgtgggctgcagtccagactctgctacttacgctatcagcctggacaagtttcttgaccactctgagctgatctagagaactggggataatagcactgagttgtcatgagaagtaaacaaaattataggaactacttggtaagaacctagca

SEQ ID NO: 6007 - DNA, 671 bp, Artificial Sequence
  Synthetic polypeptide
atggtttcacgaaggcctctctcgacaccaggcagagaacttactcatgggcaaggaggttggcttcttcatcatccgggccagccagagctccccaggggacttctccatctctgtcagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcaggggcaatgtggagaggtggaaaagtcacaagctttgagtcagaaacacgtgggctgcagtccagactctgctacttacgctatcagcctggacaagtttcttgaccactctgagctgatctagagaactggggataatagcactgagttgtcatgagaagtaaacaaaattataggaactacttggtaagaacctagca

SEQ ID NO: 6008 - DNA, 822 bp, Artificial Sequence; identical to SEQ ID NO: 119
  Synthetic polypeptide

SEQ ID NO: 6009 - DNA, 2409 bp, Artificial Sequence; identical to SEQ ID NO: 1481
  Synthetic polypeptide

SEQ ID NO: 6010 - DNA, 124 bp, Artificial Sequence
  Synthetic polypeptide
atggaacatagcacgtttctctctggcctggtactggctacccttctctcgcaagttttaaaatggaaagtcccatgtccgaggaaccccttcaacactaagcaaactgggtccaatggtcacc

SEQ ID NO: 6011 - DNA, 168 bp, Artificial Sequence
  Synthetic polypeptide
atgggacagctgatcgccaagttaatgagcatcttcgggaaccaggagcacacggtcatcatcgtgggactggacaatgaaggaaagaccaccattctctaccggtttgtggtctacagaccagtcacacaggcatcacctgaaagcttattaggaatgcaaaaccat

SEQ ID NO: 6012 - DNA, 317 bp, Artificial Sequence; identical to SEQ ID NO: 995
  Synthetic polypeptide

SEQ ID NO: 6013 - DNA, 562 bp, Artificial Sequence
  Synthetic polypeptide
atgaaacatctgtggttcttccttctcctggtggcagctcccagatgggtcctgtcccaggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagacacagtgaggggaggcagagaagaggccatgtggagacgtaatgcactagaaggtggcccagtgcaagccaggaagaagcctcaccaagaaccaaccctgccagaacattgatcttcaacattcagactgcagaattttaagaaaatcaatatttgttgtttaagccacccactcctgttgtcttcttatgaagatccagacagactaatac

SEQ ID NO: 6014 - DNA, 228 bp, Artificial Sequence
  Synthetic polypeptide
atggccggtacatggctgctacttctcctggcccttgggtgtccagccctacccacagccgggcgctgtggcgggcacctgtagtcccagctactcaggaggctgaggcaggagaatggcatgaacccaggaggtggaacttgcagtgagctgagatcgcgccactgcactctagcctgggcaacagagcaaaattccatctcaaaaaaaaaaaaaagaaagaaagaa

SEQ ID NO: 6015 - DNA, 1490 bp, Artificial Sequence; identical to SEQ ID NO: 1677
  Synthetic polypeptide

SEQ ID NO: 6016 - DNA, 1451 bp, Artificial Sequence; identical to SEQ ID NO: 1678
  Synthetic polypeptide

SEQ ID NO: 6017 - DNA, 926 bp, Artificial Sequence; identical to SEQ ID NO: 1679
  Synthetic polypeptide

SEQ ID NO: 6018 - DNA, 1451 bp, Artificial Sequence; identical to SEQ ID NO: 1680
  Synthetic polypeptide

SEQ ID NO: 6019 - DNA, 1033 bp, Artificial Sequence; identical to SEQ ID NO: 1822
  Synthetic polypeptide

SEQ ID NO: 6020 - DNA, 1075 bp, Artificial Sequence; identical to SEQ ID NO: 1823
  Synthetic polypeptide

SEQ ID NO: 6021 - DNA, 1081 bp, Artificial Sequence; identical to SEQ ID NO: 986
  Synthetic polypeptide

SEQ ID NO: 6022 - DNA, 1054 bp, Artificial Sequence; identical to SEQ ID NO: 987
  Synthetic polypeptide

SEQ ID NO: 6023 - DNA, 2107 bp, Artificial Sequence; identical to SEQ ID NO: 5673
  Synthetic polypeptide

SEQ ID NO: 6024 - DNA, 1221 bp, Artificial Sequence; identical to SEQ ID NO: 122
  Synthetic polypeptide

SEQ ID NO: 6025 - DNA, 2564 bp, Artificial Sequence; identical to SEQ ID NO: 3321
  Synthetic polypeptide

SEQ ID NO: 6026 - DNA, 3077 bp, Artificial Sequence; identical to SEQ ID NO: 3322
  Synthetic polypeptide

SEQ ID NO: 6027 - DNA, 3038 bp, Artificial Sequence; identical to SEQ ID NO: 3323
  Synthetic polypeptide

SEQ ID NO: 6028 - DNA, 652 bp, Artificial Sequence
  Synthetic polypeptide
atgaacctgtggctcctggcctgcctggtggccggcttcctgggagcctgggcccccgctgtccacacccaaggtgtctttgaggactgctgcctggcctaccactaccccattgggtgggctgtgctccggcgcgcctggacttaccggatccaggaggtgagcgggagctgcaatctgcctgctgcgatattctacctccccaagagacacaggaaggtgtgtgggaaccccaaaagcagggaggtgcagagagccatgaagctcctggatgctcgaaataaggtttttgcaaagctccaccacaacacgcagaccttccaaggccctcatgctgtaaagaagttgagttctggaaactccaagttatcatcgtccaagtttagcaatcccatcagcagcagcaagaggaacgcttgagcccagcctgggcaacatggtgaaatcccatctctacaaaaaagtacaaaaattagctgggtgtggtggcacccgcctgtagtcctagctacttgggatgctgaggtgggaggatcacttaggcccaagacgcagaggtagcaatgagccgtgatctcgccacggcactctagcctgagcaacagaaccaggccctgtcttctaaaaaaaaaaaaaaaaaaaaagaaagaaa

SEQ ID NO: 6029 - DNA, 655 bp, Artificial Sequence
  Synthetic polypeptide
atgaacctgtggctcctggcctgcctggtggccggcttcctgggagcctgggcccccgctgtccacacccaaggtgtctttgaggactgctgcctggcctaccactaccccattgggtgggctgtgctccggcgcgcctggacttaccggatccaggaggtgagcgggagctgcaatctgcctgctgcgatattctacctccccaagagacacaggaaggtgtgtgggaaccccaaaagcagggaggtgcagagagccatgaagctcctggatgctcgaaataaggtttttgcaaagctccaccacaacacgcagaccttccaagcaggccctcatgctgtaaagaagttgagttctggaaactccaagttatcatcgtccaagtttagcaatcccatcagcagcagcaagaggaacgcttgagcccagcctgggcaacatggtgaaatcccatctctacaaaaaagtacaaaaattagctgggtgtggtggcacccgcctgtagtcctagctacttgggatgctgaggtgggaggatcacttaggcccaagacgcagaggtagcaatgagccgtgatctcgccacggcactctagcctgagcaacagaaccaggccctgtcttctaaaaaaaaaaaaaaaaaaaaagaaagaaa

SEQ ID NO: 6030 - DNA, 1598 bp, Artificial Sequence; identical to SEQ ID NO: 1699
  Synthetic polypeptide

SEQ ID NO: 6031 - DNA, 814 bp, Artificial Sequence
  Synthetic polypeptide
atggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagcgttactgggtgaatgaccaacattgggttggccaggatggacccatattcctgcatctagggggtgagggcagccttgggcctggctcagtgatgagaggccatcccgcagccttggccccagcctggggcgccctggtgataagcctggaacacagattttatggcctgagtatacctgctggaggcctggaaatggcccagctccgcttcttgtccagccgccttgcgtggaaatcagagtaattctgttagagcataaaccaggacatgatcctccctggcttaagtccctcagacatcttctgtattgcttcagaagtaaagcaattttgactgtatttgacttcagagtaaagtcaaagcttttacagtcgccatggagtccagtgggttttggcctctagttaactctgacctatactctctcactttcactgggctccagctacattgaagtcctcactgtcctccagacttacacgcacattcctgccttgagcctttgaactcatccctctgcatggcgtggccttcccctagatgtttttatgcctctcaccccagcctccttcag

SEQ ID NO: 6032 - DNA, 488 bp, Artificial Sequence
  Synthetic polypeptide
agtgatgagaggccatcccgcagccttggccccagcctggggcgccctggtgataagcctggaacacagattttatggcctgagtatacctgctggaggcctggaaatggcccagctccgcttcttgtccagccgccttgcgtggaaatcagagtaattctgttagagcataaaccaggacatgatcctccctggcttaagtccctcagacatcttctgtattgcttcagaagtaaagcaattttgactgtatttgacttcagagtaaagtcaaagcttttacagtcgccatggagtccagtgggttttggcctctagttaactctgacctatactctctcactttcactgggctccagctacattgaagtcctcactgtcctccagacttacacgcacattcctgccttgagcctttgaactcatccctctgcatggcgtggccttcccctagatgtttttatgcctctcaccccagcctccttcag

SEQ ID NO: 6033 - DNA, 681 bp, Artificial Sequence; identical to SEQ ID NO: 1642
  Synthetic polypeptide

SEQ ID NO: 6034 - DNA, 534 bp, Artificial Sequence; identical to SEQ ID NO: 1643
  Synthetic polypeptide

SEQ ID NO: 6035 - DNA, 270 bp, Artificial Sequence; identical to SEQ ID NO: 1644
  Synthetic polypeptide

SEQ ID NO: 6036 - DNA, 596 bp, Artificial Sequence; identical to SEQ ID NO: 1645
  Synthetic polypeptide

SEQ ID NO: 6037 - DNA, 344 bp, Artificial Sequence; identical to SEQ ID NO: 1869
  Synthetic polypeptide

SEQ ID NO: 6038 - DNA, 1420 bp, Artificial Sequence; identical to SEQ ID NO: 924
  Synthetic polypeptide

SEQ ID NO: 6039 - DNA, 1336 bp, Artificial Sequence; identical to SEQ ID NO: 925
  Synthetic polypeptide

SEQ ID NO: 6040 - DNA, 1069 bp, Artificial Sequence; identical to SEQ ID NO: 926
  Synthetic polypeptide

SEQ ID NO: 6041 - DNA, 1345 bp, Artificial Sequence; identical to SEQ ID NO: 927
  Synthetic polypeptide

SEQ ID NO: 6042 - DNA, 652 bp, Artificial Sequence
  Synthetic polypeptide
atggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgaagcctggaagaaggagttgaaggagctagcttcccgggtggccttcctcaccaaggaggatgaactgaagaagaaagagagtggacaggcagaggcccggcttctcattcctgctcacaactaactcactgcagcactcaggacaactcagctaagctgtctgggtctctgttttcttatctttaaaatggggggaaggatactaccagtcttaattggaattg

SEQ ID NO: 6043 - DNA, 619 bp, Artificial Sequence
  Synthetic polypeptide
atgtatataagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgcctggaagaaggagttgaaggagctagcttcccgggtggccttcctcaccaaggaggatgaactgaagaagaaagagagtggacaggcagaggcccggcttctcattcctgctcacaactaactcactgcagcactcaggacaactcagctaagctgtctgggtctctgttttcttatctttaaaatggggggaaggatactaccagtcttaattggaattg

SEQ ID NO: 6044 - DNA, 316 bp, Artificial Sequence; identical to SEQ ID NO: 1815
  Synthetic polypeptide

SEQ ID NO: 6045 - DNA, 464 bp, Artificial Sequence; identical to SEQ ID NO: 1863
  Synthetic polypeptide

SEQ ID NO: 6046 - DNA, 909 bp, Artificial Sequence; identical to SEQ ID NO: 1830
  Synthetic polypeptide

SEQ ID NO: 6047 - DNA, 963 bp, Artificial Sequence; identical to SEQ ID NO: 1831
  Synthetic polypeptide

SEQ ID NO: 6048 - DNA, 876 bp, Artificial Sequence; identical to SEQ ID NO: 1832
  Synthetic polypeptide

SEQ ID NO: 6049 - DNA, 2466 bp, Artificial Sequence; identical to SEQ ID NO: 1682
  Synthetic polypeptide

SEQ ID NO: 6050 - DNA, 1806 bp, Artificial Sequence; identical to SEQ ID NO: 1683
  Synthetic polypeptide

SEQ ID NO: 6051 - DNA, 2412 bp, Artificial Sequence; identical to SEQ ID NO: 1684
  Synthetic polypeptide

SEQ ID NO: 6052 - DNA, 2211 bp, Artificial Sequence; identical to SEQ ID NO: 1685
  Synthetic polypeptide

SEQ ID NO: 6053 - DNA, 364 bp, Artificial Sequence; identical to SEQ ID NO: 1686
  Synthetic polypeptide

SEQ ID NO: 6054 - DNA, 1731 bp, Artificial Sequence; identical to SEQ ID NO: 989
  Synthetic polypeptide

SEQ ID NO: 6055 - DNA, 2262 bp, Artificial Sequence; identical to SEQ ID NO: 990
  Synthetic polypeptide

SEQ ID NO: 6056 - DNA, 2253 bp, Artificial Sequence; identical to SEQ ID NO: 991
  Synthetic polypeptide

SEQ ID NO: 6057 - DNA, 105 bp, Artificial Sequence
  Synthetic polypeptide
atgaacgtgatgggttttaacacagaccgcttagcatggactagaaatgacctgtggtattgcctggcatagaaggatactcagtgaacatttgttgagtgaatg

SEQ ID NO: 6058 - DNA, 734 bp, Artificial Sequence; identical to SEQ ID NO: 930
  Synthetic polypeptide

SEQ ID NO: 6059 - DNA, 678 bp, Artificial Sequence
  Synthetic polypeptide
atggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggactgggcatgcctgtaatcccaactactagggaggctgaggcaggagaatcggttaaacccgggaggcagaggctgcagtgagccaagatcacgctattgcactccagccagggcaacaagagcgaaactccatctcaaaagaaaaaaagaaaaaaa

SEQ ID NO: 6060 - DNA, 1823 bp, Artificial Sequence
  Synthetic polypeptide
atggcagaagatgatccatatttgggaaggcctgaacaaatgtttcatttggatccttctttgactcatacaatatttaatccagaagtatttcaaccacagatggcactgccaacagcagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagaggtcttccaacactgcaaagggagagttagctggagacacagcgaggccctttgatgggcatatgcagaa

SEQ ID NO: 6061 - DNA, 1820 bp, Artificial Sequence
  Synthetic polypeptide
atggcagaagatgatccatatttgggaaggcctgaacaaatgtttcatttggatccttctttgactcatacaatatttaatccagaagtatttcaaccacagatggcactgccaacagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagaggtcttccaacactgcaaagggagagttagctggagacacagcgaggccctttgatgggcatatgcagaa

SEQ ID NO: 6062 - DNA, 1280 bp, Artificial Sequence
  Synthetic polypeptide
atgaatggactgtgctgtatggccctagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagaggtcttccaacactgcaaagggagagttagctggagacacagcgaggccctttgatgggcatatgcagaa

SEQ ID NO: 6063 - DNA, 1689 bp, Artificial Sequence; identical to SEQ ID NO: 964
  Synthetic polypeptide

SEQ ID NO: 6064 - DNA, 1671 bp, Artificial Sequence; identical to SEQ ID NO: 965
  Synthetic polypeptide

SEQ ID NO: 6065 - DNA, 650 bp, Artificial Sequence; identical to SEQ ID NO: 966
  Synthetic polypeptide

SEQ ID NO: 6066 - DNA, 105 bp, Artificial Sequence; identical to SEQ ID NO: 6057
  Synthetic polypeptide

SEQ ID NO: 6067 - DNA, 105 bp, Artificial Sequence; identical to SEQ ID NO: 6057
  Synthetic polypeptide

SEQ ID NO: 6068 - DNA, 303 bp, Artificial Sequence
  Synthetic polypeptide
atggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaaggatactaccagtcttaattggaattg

SEQ ID NO: 6069 - DNA, 273 bp, Artificial Sequence
  Synthetic polypeptide
atgtatataagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaaggatactaccagtcttaattggaattg

SEQ ID NO: 6070 - DNA, 860 bp, Artificial Sequence; identical to SEQ ID NO: 2285
  Synthetic polypeptide

SEQ ID NO: 6071 - DNA, 1823 bp, Artificial Sequence; identical to SEQ ID NO: 2286
  Synthetic polypeptide

SEQ ID NO: 6072 - DNA, 1796 bp, Artificial Sequence; identical to SEQ ID NO: 2287
  Synthetic polypeptide

SEQ ID NO: 6073 - DNA, 904 bp, Artificial Sequence; identical to SEQ ID NO: 5647
  Synthetic polypeptide

SEQ ID NO: 6074 - DNA, 1072 bp, Artificial Sequence; identical to SEQ ID NO: 5648
  Synthetic polypeptide

SEQ ID NO: 6075 - DNA, 1587 bp, Artificial Sequence; identical to SEQ ID NO: 3984
  Synthetic polypeptide

SEQ ID NO: 6076 - DNA, 117 bp, Artificial Sequence; identical to SEQ ID NO: 928
  Synthetic polypeptide

SEQ ID NO: 6077 - DNA, 51 bp, Artificial Sequence; identical to SEQ ID NO: 929
  Synthetic polypeptide

SEQ ID NO: 6078 - DNA, 1105 bp, Artificial Sequence
  Synthetic polypeptide
atgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtgctgcggtgggaagattgctggagcccaggagttcgaggctgcggtgagccatgatcacaccactgtactccagcaacacagcgaaaccctgtctc

SEQ ID NO: 6079 - DNA, 1021 bp, Artificial Sequence
  Synthetic polypeptide
atgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtgctgcggtgggaagattgctggagcccaggagttcgaggctgcggtgagccatgatcacaccactgtactccagcaacacagcgaaaccctgtctc

SEQ ID NO: 6080 - DNA, 817 bp, Artificial Sequence
  Synthetic polypeptide
atggcagaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtgctgcggtgggaagattgctggagcccaggagttcgaggctgcggtgagccatgatcacaccactgtactccagcaacacagcgaaaccctgtctc

SEQ ID NO: 6081 - DNA, 105 bp, Artificial Sequence; identical to SEQ ID NO: 6057
  Synthetic polypeptide

SEQ ID NO: 6082 - DNA, 346 bp, Artificial Sequence
  Synthetic polypeptide
atggtttggcagcagaagaccaaagcagttgtcatgctgaaccgcattgtggagaaagaatcggttggagggcttacacctataatcccagcactttgggaggctgaggcaggagggtcacttgagcccaggaattcaaaaccagcctcgacaacaaagtgagaccctgcctctacaaaaaatacaaaaagtagccaggtgtggtggcacgcacctggagtcccagctggggttgggggattgcttgagcccagaagattgaggctgaagtgagccaagttcaccccagtgcactccagcctgggctactacagagcaagacactgtctcttaaaaaaaaaaaaaa

SEQ ID NO: 6083 - DNA, 643 bp, Artificial Sequence
  Synthetic polypeptide
atgcccaccaccatcgagcgggagttcgaagagttggatactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttggagggcttacacctataatcccagcactttgggaggctgaggcaggagggtcacttgagcccaggaattcaaaaccagcctcgacaacaaagtgagaccctgcctctacaaaaaatacaaaaagtagccaggtgtggtggcacgcacctggagtcccagctggggttgggggattgcttgagcccagaagattgaggctgaagtgagccaagttcaccccagtgcactccagcctgggctactacagagcaagacactgtctcttaaaaaaaaaaaaaa

SEQ ID NO: 6084 - DNA, 416 bp, Artificial Sequence
  Synthetic polypeptide
agaagaggcacaaaggagttacatcttaacacagggtccacttcctaacacatgctgccatttctggcttatggtttggcagcagaagaccaaagcagttgtcatgctgaaccgcattgtggagaaagaatcggttggagggcttacacctataatcccagcactttgggaggctgaggcaggagggtcacttgagcccaggaattcaaaaccagcctcgacaacaaagtgagaccctgcctctacaaaaaatacaaaaagtagccaggtgtggtggcacgcacctggagtcccagctggggttgggggattgcttgagcccagaagattgaggctgaagtgagccaagttcaccccagtgcactccagcctgggctactacagagcaagacactgtctcttaaaaaaaaaaaaaa

SEQ ID NO: 6085 - DNA, 556 bp, Artificial Sequence
  Synthetic polypeptide
atgtatggaaaggatggtaaaggcaccaactggatggatcagggagacatggaatgcagaatgcaggaaatagatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttggagggcttacacctataatcccagcactttgggaggctgaggcaggagggtcacttgagcccaggaattcaaaaccagcctcgacaacaaagtgagaccctgcctctacaaaaaatacaaaaagtagccaggtgtggtggcacgcacctggagtcccagctggggttgggggattgcttgagcccagaagattgaggctgaagtgagccaagttcaccccagtgcactccagcctgggctactacagagcaagacactgtctcttaaaaaaaaaaaaaa

SEQ ID NO: 6086 - DNA, 1213 bp, Artificial Sequence; identical to SEQ ID NO: 1093
  Synthetic polypeptide

SEQ ID NO: 6087 - DNA, 616 bp, Artificial Sequence; identical to SEQ ID NO: 1094
  Synthetic polypeptide

SEQ ID NO: 6088 - DNA, 868 bp, Artificial Sequence; identical to SEQ ID NO: 1095
  Synthetic polypeptide

SEQ ID NO: 6089 - DNA, 528 bp, Artificial Sequence; identical to SEQ ID NO: 1280
  Synthetic polypeptide

SEQ ID NO: 6090 - DNA, 438 bp, Artificial Sequence; identical to SEQ ID NO: 1281
  Synthetic polypeptide

SEQ ID NO: 6091 - DNA, 453 bp, Artificial Sequence
  Synthetic polypeptide
atggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctggatactaccagtcttaattggaattg

SEQ ID NO: 6092 - DNA, 423 bp, Artificial Sequence
  Synthetic polypeptide
atgtatataagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctggatactaccagtcttaattggaattg

SEQ ID NO: 6093 - DNA, 1537 bp, Artificial Sequence
  Synthetic polypeptide
atggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcagtgattctgtcacccacatcgtagcagagaacaactcgggttcggatgttctggagtggcttcaagcacagaaagtacaagtcagctcacaaccagagctcctcgatgtctcctggctgatcgaatgcataagagcagggaaaccggtggaaatgacaggaaaacaccagcttgttgtgagaagagactattcagatagcaccaacccaggccccccgaagactccaccaattgctgtacaaaagatctcccagtatgcgtgtcagagaagaaccactttaaacaactgtaaccagatattcacggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggagattattgaagatggagaaagttctgaagttaaagctgtgttaaatgatgaacgatatcaatccttcaaactctttacttctgtatttggagtggggctgaagacttctgagaagtggttcaggatgggtttcagaactctgagtaaagtaaggtcggacaaaagcctgaaatttacacgaatgcagaaagcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggggtaagaagatggggcatgatgtagattttttaattaccagcccaggatcaacagaggatgaagagcaacttttacagaaagtgatgaacttatgggaaaagaagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccggtttgagagagacctccggcgctatgccacacatgagcggaagatgattctggataaccatgctttatatgacaagaccaagaactcctttgagacagaaaactgttgaatttagaagtattttgtgttttctccttggagtagaaggtaagacccccaaagggcatggtctaacaaga

SEQ ID NO: 6094 - DNA, 1540 bp, Artificial Sequence
  Synthetic polypeptide
atggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcagtgattctgtcacccacatcgtagcagagaacaactcgggttcggatgttctggagtggcttcaagcacagaaagtacaagtcagctcacaaccagagctcctcgatgtctcctggctgatcgaatgcataagagcagggaaaccggtggaaatgacaggaaaacaccagcttgttgtgagaagagactattcagatagcaccaacccaggccccccgaagactccaccaattgctgtacaaaagatctcccagtatgcgtgtcagagaagaaccactttaaacaactgtaaccagatattcacggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggagattattgaagatggagaaagttctgaagttaaagctgtgttaaatgatgaacgatatcaatccttcaaactctttacttctgtatttggagtggggctgaagacttctgagaagtggttcaggatgggtttcagaactctgagtaaagtaaggtcggacaaaagcctgaaatttacacgaatgcagaaagcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggggtaagaagatggggcatgatgtagattttttaattaccagcccaggatcaacagaggatgaagagcaacttttacagaaagtgatgaacttatgggaaaagaagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccggcagtttgagagagacctccggcgctatgccacacatgagcggaagatgattctggataaccatgctttatatgacaagaccaagaactcctttgagacagaaaactgttgaatttagaagtattttgtgttttctccttggagtagaaggtaagacccccaaagggcatggtctaacaaga

SEQ ID NO: 6095 - DNA, 597 bp, Artificial Sequence
  Synthetic polypeptide
atggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgaagcctggaagaaggagttgaaggagctagcttcccgggtggccttcctcaccaaggaggatgaactgaagaagaaagagcactcaggacaactcagctaagctgtctgggtctctgttttcttatctttaaaatggggggaaggatactaccagtcttaattggaattg

SEQ ID NO: 6096 - DNA, 564 bp, Artificial Sequence
  Synthetic polypeptide
atgtatataagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgcctggaagaaggagttgaaggagctagcttcccgggtggccttcctcaccaaggaggatgaactgaagaagaaagagcactcaggacaactcagctaagctgtctgggtctctgttttcttatctttaaaatggggggaaggatactaccagtcttaattggaattg

SEQ ID NO: 6097 - DNA, 138 bp, Artificial Sequence
  Synthetic polypeptide
atggccggtacatggctgctacttctcctggcccttgggtgtccagccctacccacagggattatctcaattttgtcatctttcaaatgggaatgtttgttaactaagtgccctgacttccaaagaatgctgcgaaga

SEQ ID NO: 6098 - DNA, 700 bp, Artificial Sequence
  Synthetic polypeptide
catctttggttcagtgaccaacataccagcaaaggatgcagcaccagtggagaaaatagacaccatgctggtcttggaaggcagtggaaacctggtgctatacacaggagtggttcgggtgggaaaggtttttattcctggactgccagctccctctctgacgatgtccaacacaatgcctcggcccagtactccactagatggcgttagtactccaaagcctcttagtaaactccttggatcattggacgaggttgttctgttgtccccagttccagaactgagggattcttcaaaacttcatgattctctctataatgaggattgtactttccaacagcttggaacttacattcattctatcagagatcctgtccataacagagtcaccctggaactgagtaatggctccatggttaggatcactattcctgaaattgccacctctgagttagtacaaacgtgtttgcaagcaattaagtttatcctgccaaaagaaatagcagttcagatgcttgtcaagtggtacaatgtccacagtgctccaggaggacccagttatcactcagagtggaatttatttgtgacttgtctcatgaacatgatgggttataacacagaccgcttagcatggactagaaatgacctgtggtattgcctggcatagaaggatactcagtgaacatttgttgagtgaatg

SEQ ID NO: 6099 - DNA, 2097 bp, Artificial Sequence
  Synthetic polypeptide
atgtcgaacttctatgaagaaaggacaacgatgattgcagcaagggatttgcaggaatttgttccttttggtcgagaccactgcaagcaccaccctaatgctttgaaccttcaacttcgccagctgcagccagcttctgaattatggtcttctgatggtgctgctggcttggtgggatcccttcaggaggttacaatccacgagaaacagaaggaaagctggcagttaaggaaaggagtaagtgaaattggagaagatgtggactatgatgaggaactctatgttgctggaaatatggtgatatggagcaaaggaagtaaaagccaggcattggcagtttataaagcatttacagttgacagtcctgttcagcaggcattgtggtgtgacttcattatatcacaggataagtctgaaaaggcctacagtagcaatgaagtagaaaaatgcatatgtatattgcaaagctcatgtattaacatgcatagcatagaaggaaaggattacatagcttcattaccatttcaggttgcaaatgtttggcccactaaatatggattgctgtttgaacgaagcgcttcttcacatgaagtacctccaggttcacccagagaacctttacctactatgttcagcatgctgcacccactagatgaaataactccacttgtttgtaaatctggaagtctttttggttcatcacgggtgcaatatgttgtagatcatgcaatgaaaattgttttcctcaatactgacccctctattgtaatgacttatgatgctgttcaaaatgtgcattctgtgtggactctccggagagtcaaatcagaggaagagaatgttgttttaaagttctctgaacaggggggaaccccacagaatgtggccactagcagctccctcacagcacatctcagaagcctctccaaaggagattcccctgtgacttcacctttccagaattactcctccattcacagccagagtcgctcaacctcatcacccagtctacattctcgctcaccttctatttccaacatggcagctctaagtcgtgctcattctcctgcgttaggagtgcactctttttcaggggtgcaaaggttcaacatttcaagccataatcagtctccaaagagacatagtatttctcattctccaaatagtaattctaatggctcctttcttgcaccagaaacggagccaattgttcctgaactgtgtattgaccatttgtggacagaaacgattactaatataagagagaaaaattcacaagcctcaaaagtgtttattacatctgacctatgtgggcaaaagttcctgtgctttttagtagagtcccagctccagttacgctgtgtaaagtttcaagagagtaatgataaaacccagctcatctttggttcagtgaccaacataccagcaaaggatgcagcaccagtggagaaaatagacaccatgctggtcttggaaggcagtggaaacctggtgctatacacaggagtggttcgggtgggaaaggtttttattcctggactgccagctccctctctgacgatgtccaacacaatgcctcggcccagtactccactagatggcgttagtactccaaagcctcttagtaaactccttggatcattggacgaggttgttctgttgtccccagttccagaactgagggattcttcaaaacttcatgattctctctataatgaggattgtactttccaacagcttggaacttacattcattctatcagagatcctgtccataacagagtcaccctggaactgagtaatggctccatggttaggatcactattcctgaaattgccacctctgagttagtacaaacgtgtttgcaagcaattaagtttatcctgccaaaagaaatagcagttcagatgcttgtcaagtggtacaatgtccacagtgctccaggaggacccagttatcactcagagtggaatttatttgtgacttgtctcatgaacatgatgggttataacacagaccgcttagcatggactagaaatgacctgtggtattgcctggcatagaaggatactcagtgaacatttgttgagtgaatg

SEQ ID NO: 6100 - DNA, 836 bp, Artificial Sequence
  Synthetic polypeptide
atgtcgaacttctatgaagaaaggacaacgatgattgcagcaagggatttgcaggaatttgttccttttggtcgagaccactgcaagcaccaccctaatgctttgaaccttcaacttcgccagctgcagccagcttctgaattatggtcttctgatggtgctgctggcttggtgggatcccttcaggaggttacaatccacgagaaacagaaggaaagctggcagttaaggaaaggagtaagtgaaattggagaagatgtggactatgatgaggaactctatgttgctggaaatatggtgatatggagcaaaggaagtaaaagccaggcattggcagtttataaagcatttacagttgacagtcctgttcagcaggaagacatgcagttcatctccatttgatgaaggaaaacttgtacttagagaagaatgctagctaataagtgtaaaaggaattgtagaattagaatatcaccattttgtaacctccagtgcaataattgattccaacaaggattgtaaatggatactaacactgttggttgaaagaatattaccatggcaccaacacatcaccctgtggattacctggtaaatgtgaaggaacaaatgtacctctactttggagttatttgtcagtctccacctcaatcaagtgattgagtttagcataattagtagtgacatgaaggagtattatgtgcttctagctataatacagaatgaagtacatgatgtcatctaagttttcttcccaaaaatatgaatatttagacctaacttcctatttataggaaatataggcaatagagaattatattttaaaataccatgag

SEQ ID NO: 6101 - DNA, 346 bp, Artificial Sequence
  Synthetic polypeptide
atggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaaggatccccccgtgggtgaggcggtcgctggtctaggtggttacaatgccctcccagctctgataatctat

SEQ ID NO: 6102 - DNA, 316 bp, Artificial Sequence
  Synthetic polypeptide
atgtatataagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaaggatccccccgtgggtgaggcggtcgctggtctaggtggttacaatgccctcccagctctgataatctat

SEQ ID NO: 6103 - DNA, 258 bp, Artificial Sequence; identical to SEQ ID NO: 265
  Synthetic polypeptide

SEQ ID NO: 6104 - DNA, 243 bp, Artificial Sequence; identical to SEQ ID NO: 267
  Synthetic polypeptide

SEQ ID NO: 6105 - DNA, 324 bp, Artificial Sequence; identical to SEQ ID NO: 268
  Synthetic polypeptide

SEQ ID NO: 6106 - DNA, 1313 bp, Artificial Sequence; identical to SEQ ID NO: 182
  Synthetic polypeptide

SEQ ID NO: 6107 - DNA, 1253 bp, Artificial Sequence; identical to SEQ ID NO: 183
  Synthetic polypeptide

SEQ ID NO: 6108 - DNA, 1259 bp, Artificial Sequence; identical to SEQ ID NO: 185
  Synthetic polypeptide

SEQ ID NO: 6109 - DNA, 1250 bp, Artificial Sequence; identical to SEQ ID NO: 187
  Synthetic polypeptide

SEQ ID NO: 6110 - DNA, 2557 bp, Artificial Sequence; identical to SEQ ID NO: 1524
  Synthetic polypeptide

SEQ ID NO: 6111 - DNA, 2428 bp, Artificial Sequence; identical to SEQ ID NO: 1525
  Synthetic polypeptide

SEQ ID NO: 6112 - DNA, 478 bp, Artificial Sequence
  Synthetic polypeptide
atggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctggttgtttcaaggactaaaggaggtaatatttgtagcattctaagaataatgcaggtctacagtaagtattccataaacctcttgctattgttattatt

SEQ ID NO: 6113 - DNA, 1249 bp, Artificial Sequence
  Synthetic polypeptide
atggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagcgttactgggtgaatgaccaacattgggttggccaggatggacccatattcctgcatctagggggtgagggcagccttgggcctggctcagtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagttcccccatctcattttcgcgtcggtcgcctcctccgccccggtgcgggccgtgctggatttctccgagtataatgacgtggtatcccgaagcctaatgagcaccgcgatcggcgggtccctggagtgccgggcggcggtgtccgtcgccttcgctgaagtggagcggcggctgcgctcgggtggggcggctcaagcagcattgcggacggagctgagcgcttgcgggcccctgggccgcgctgaaaaccaggcggagctgttgggggcgctgcaggcactggtgggaggtgtagtgcagtatgatgggcagacgggagcgccgctaagcgtgcgacagctctgcggacttctcctcgggggcgggggcaaccgcagccactccacgccctactgcgggcttcgtcgggcggtgcagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctggttgtttcaaggactaaaggaggtaatatttgtagcattctaagaataatgcaggtctacagtaagtattccataaacctcttgctattgttattatt

SEQ ID NO: 6114 - DNA, 584 bp, Artificial Sequence
  Synthetic polypeptide
agtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagttcccccatctcattttcgcgtcggtcgcctcctccgccccggtgcgggccgtgctggatttctccgagtataatgacattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctggttgtttcaaggactaaaggaggtaatatttgtagcattctaagaataatgcaggtctacagtaagtattccataaacctcttgctattgttattatt

SEQ ID NO: 6115 - DNA, 506 bp, Artificial Sequence
  Synthetic polypeptide
agtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctggttgtttcaaggactaaaggaggtaatatttgtagcattctaagaataatgcaggtctacagtaagtattccataaacctcttgctattgttattatt

SEQ ID NO: 6116 - DNA, 1032 bp, Artificial Sequence; identical to SEQ ID NO: 1790
  Synthetic polypeptide

SEQ ID NO: 6117 - DNA, 289 bp, Artificial Sequence; identical to SEQ ID NO: 1791
  Synthetic polypeptide

SEQ ID NO: 6118 - DNA, 1314 bp, Artificial Sequence; identical to SEQ ID NO: 1792
  Synthetic polypeptide

SEQ ID NO: 6119 - DNA, 620 bp, Artificial Sequence; identical to SEQ ID NO: 1793
  Synthetic polypeptide

SEQ ID NO: 6120 - DNA, 559 bp, Artificial Sequence; identical to SEQ ID NO: 1701
  Synthetic polypeptide

SEQ ID NO: 6121 - DNA, 1398 bp, Artificial Sequence; identical to SEQ ID NO: 948
  Synthetic polypeptide

SEQ ID NO: 6122 - DNA, 1302 bp, Artificial Sequence; identical to SEQ ID NO: 949
  Synthetic polypeptide

SEQ ID NO: 6123 - DNA, 1081 bp, Artificial Sequence; identical to SEQ ID NO: 986
  Synthetic polypeptide

SEQ ID NO: 6124 - DNA, 1054 bp, Artificial Sequence; identical to SEQ ID NO: 987
  Synthetic polypeptide

SEQ ID NO: 6125 - DNA, 2409 bp, Artificial Sequence; identical to SEQ ID NO: 1481
  Synthetic polypeptide

SEQ ID NO: 6126 - DNA, 1834 bp, Artificial Sequence; identical to SEQ ID NO: 133
  Synthetic polypeptide

SEQ ID NO: 6127 - DNA, 1765 bp, Artificial Sequence; identical to SEQ ID NO: 135
  Synthetic polypeptide

SEQ ID NO: 6128 - DNA, 1221 bp, Artificial Sequence; identical to SEQ ID NO: 122
  Synthetic polypeptide

SEQ ID NO: 6129 - DNA, 860 bp, Artificial Sequence; identical to SEQ ID NO: 2285
  Synthetic polypeptide

SEQ ID NO: 6130 - DNA, 1823 bp, Artificial Sequence; identical to SEQ ID NO: 2286
  Synthetic polypeptide

SEQ ID NO: 6131 - DNA, 1796 bp, Artificial Sequence; identical to SEQ ID NO: 2287
  Synthetic polypeptide

SEQ ID NO: 6132 - DNA, 1063 bp, Artificial Sequence; identical to SEQ ID NO: 2221
  Synthetic polypeptide

SEQ ID NO: 6133 - DNA, 640 bp, Artificial Sequence; identical to SEQ ID NO: 1700
  Synthetic polypeptide

SEQ ID NO: 6134 - DNA, 1146 bp, Artificial Sequence; identical to SEQ ID NO: 988
  Synthetic polypeptide

SEQ ID NO: 6135 - DNA, 117 bp, Artificial Sequence; identical to SEQ ID NO: 928
  Synthetic polypeptide

SEQ ID NO: 6136 - DNA, 51 bp, Artificial Sequence; identical to SEQ ID NO: 929
  Synthetic polypeptide

SEQ ID NO: 6137 - DNA, 1743 bp, Artificial Sequence; identical to SEQ ID NO: 1253
  Synthetic polypeptide

SEQ ID NO: 6138 - DNA, 1518 bp, Artificial Sequence; identical to SEQ ID NO: 1254
  Synthetic polypeptide

SEQ ID NO: 6139 - DNA, 1767 bp, Artificial Sequence; identical to SEQ ID NO: 1255
  Synthetic polypeptide

SEQ ID NO: 6140 - DNA, 2362 bp, Artificial Sequence; identical to SEQ ID NO: 1664
  Synthetic polypeptide

SEQ ID NO: 6141 - DNA, 2113 bp, Artificial Sequence; identical to SEQ ID NO: 1665
  Synthetic polypeptide

SEQ ID NO: 6142 - DNA, 1399 bp, Artificial Sequence; identical to SEQ ID NO: 1666
  Synthetic polypeptide

SEQ ID NO: 6143 - DNA, 2080 bp, Artificial Sequence; identical to SEQ ID NO: 1667
  Synthetic polypeptide

SEQ ID NO: 6144 - DNA, 317 bp, Artificial Sequence; identical to SEQ ID NO: 995
  Synthetic polypeptide

SEQ ID NO: 6145 - DNA, 696 bp, Artificial Sequence; identical to SEQ ID NO: 2305
  Synthetic polypeptide

SEQ ID NO: 6146 - DNA, 1379 bp, Artificial Sequence; identical to SEQ ID NO: 985
  Synthetic polypeptide

SEQ ID NO: 6147 - DNA, 1052 bp, Artificial Sequence; identical to SEQ ID NO: 247
  Synthetic polypeptide

SEQ ID NO: 6148 - DNA, 327 bp, Artificial Sequence; identical to SEQ ID NO: 246
  Synthetic polypeptide

SEQ ID NO: 6149 - DNA, 2161 bp, Artificial Sequence; identical to SEQ ID NO: 288
  Synthetic polypeptide

SEQ ID NO: 6150 - DNA, 2140 bp, Artificial Sequence; identical to SEQ ID NO: 289
  Synthetic polypeptide

SEQ ID NO: 6151 - DNA, 529 bp, Artificial Sequence; identical to SEQ ID NO: 287
  Synthetic polypeptide

SEQ ID NO: 6152 - DNA, 577 bp, Artificial Sequence; identical to SEQ ID NO: 1112
  Synthetic polypeptide

SEQ ID NO: 6153 - DNA, 252 bp, Artificial Sequence; identical to SEQ ID NO: 1113
  Synthetic polypeptide

SEQ ID NO: 6154 - DNA, 980 bp, Artificial Sequence; identical to SEQ ID NO: 139
  Synthetic polypeptide

SEQ ID NO: 6155 - DNA, 1256 bp, Artificial Sequence; identical to SEQ ID NO: 140
  Synthetic polypeptide

SEQ ID NO: 6156 - DNA, 1277 bp, Artificial Sequence; identical to SEQ ID NO: 142
  Synthetic polypeptide

SEQ ID NO: 6157 - DNA, 2160 bp, Artificial Sequence; identical to SEQ ID NO: 4209
  Synthetic polypeptide

SEQ ID NO: 6158 - DNA, 2625 bp, Artificial Sequence; identical to SEQ ID NO: 4210
  Synthetic polypeptide

SEQ ID NO: 6159 - DNA, 2849 bp, Artificial Sequence; identical to SEQ ID NO: 1326
  Synthetic polypeptide

SEQ ID NO: 6160 - DNA, 1925 bp, Artificial Sequence; identical to SEQ ID NO: 1327
  Synthetic polypeptide

SEQ ID NO: 6161 - DNA, 2729 bp, Artificial Sequence; identical to SEQ ID NO: 1328
  Synthetic polypeptide

SEQ ID NO: 6162 - DNA, 2549 bp, Artificial Sequence; identical to SEQ ID NO: 1329
  Synthetic polypeptide

SEQ ID NO: 6163 - DNA, 810 bp, Artificial Sequence; identical to SEQ ID NO: 4445
  Synthetic polypeptide

SEQ ID NO: 6164 - DNA, 372 bp, Artificial Sequence; identical to SEQ ID NO: 1188
  Synthetic polypeptide

SEQ ID NO: 6165 - DNA, 392 bp, Artificial Sequence; identical to SEQ ID NO: 410
  Synthetic polypeptide

SEQ ID NO: 6166 - DNA, 1094 bp, Artificial Sequence; identical to SEQ ID NO: 153
  Synthetic polypeptide

SEQ ID NO: 6167 - DNA, 609 bp, Artificial Sequence; identical to SEQ ID NO: 249
  Synthetic polypeptide

SEQ ID NO: 6168 - DNA, 738 bp, Artificial Sequence; identical to SEQ ID NO: 250
  Synthetic polypeptide

SEQ ID NO: 6169 - DNA, 537 bp, Artificial Sequence; identical to SEQ ID NO: 251
  Synthetic polypeptide

SEQ ID NO: 6170 - DNA, 684 bp, Artificial Sequence; identical to SEQ ID NO: 253
  Synthetic polypeptide

SEQ ID NO: 6171 - DNA, 285 bp, Artificial Sequence; identical to SEQ ID NO: 255
  Synthetic polypeptide

SEQ ID NO: 6172 - DNA, 552 bp, Artificial Sequence; identical to SEQ ID NO: 254
  Synthetic polypeptide

SEQ ID NO: 6173 - DNA, 1062 bp, Artificial Sequence
  Synthetic polypeptide
atggcggtggacatcacgctgctattccgggccagcgtcaagaccgtgaagacgcggaacaaggcgctgggagtggcggtgggcggcggggtcgatggcagccgggacgagctgttccgccggagcccccggcccaagggcgacttctccagccgggcccgcgaagtgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtccctcacctataaaatgcggccaatgagtcacaccaccgtgttgctgaggactcaagtcaatgca

SEQ ID NO: 6174 - DNA, 281 bp, Artificial Sequence; identical to SEQ ID NO: 1368
  Synthetic polypeptide

SEQ ID NO: 6175 - DNA, 128 bp, Artificial Sequence; identical to SEQ ID NO: 144
  Synthetic polypeptide

SEQ ID NO: 6176 - DNA, 884 bp, Artificial Sequence; identical to SEQ ID NO: 2542
  Synthetic polypeptide

SEQ ID NO: 6177 - DNA, 312 bp, Artificial Sequence; identical to SEQ ID NO: 1728
  Synthetic polypeptide

SEQ ID NO: 6178 - DNA, 299 bp, Artificial Sequence; identical to SEQ ID NO: 1033
  Synthetic polypeptide

SEQ ID NO: 6179 - DNA, 191 bp, Artificial Sequence; identical to SEQ ID NO: 1034
  Synthetic polypeptide

SEQ ID NO: 6180 - DNA, 128 bp, Artificial Sequence; identical to SEQ ID NO: 1082
  Synthetic polypeptide

SEQ ID NO: 6181 - DNA, 500 bp, Artificial Sequence; identical to SEQ ID NO: 204
  Synthetic polypeptide

SEQ ID NO: 6182 - DNA, 656 bp, Artificial Sequence; identical to SEQ ID NO: 205
  Synthetic polypeptide

SEQ ID NO: 6183 - DNA, 524 bp, Artificial Sequence; identical to SEQ ID NO: 207
  Synthetic polypeptide

SEQ ID NO: 6184 - DNA, 1041 bp, Artificial Sequence; identical to SEQ ID NO: 969
  Synthetic polypeptide

SEQ ID NO: 6185 - DNA, 1372 bp, Artificial Sequence; identical to SEQ ID NO: 1756
  Synthetic polypeptide

SEQ ID NO: 6186 - DNA, 3308 bp, Artificial Sequence; identical to SEQ ID NO: 428
  Synthetic polypeptide

SEQ ID NO: 6187 - DNA, 3203 bp, Artificial Sequence; identical to SEQ ID NO: 429
  Synthetic polypeptide

SEQ ID NO: 6188 - DNA, 2849 bp, Artificial Sequence; identical to SEQ ID NO: 430
  Synthetic polypeptide

SEQ ID NO: 6189 - DNA, 388 bp, Artificial Sequence; identical to SEQ ID NO: 431
  Synthetic polypeptide

SEQ ID NO: 6190 - DNA, 1065 bp, Artificial Sequence; identical to SEQ ID NO: 4373
  Synthetic polypeptide

SEQ ID NO: 6191 - DNA, 4932 bp, Artificial Sequence; identical to SEQ ID NO: 3990
  Synthetic polypeptide

SEQ ID NO: 6192 - DNA, 117 bp, Artificial Sequence; identical to SEQ ID NO: 928
  Synthetic polypeptide

SEQ ID NO: 6193 - DNA, 51 bp, Artificial Sequence; identical to SEQ ID NO: 929
  Synthetic polypeptide

SEQ ID NO: 6194 - DNA, 2409 bp, Artificial Sequence; identical to SEQ ID NO: 1481
  Synthetic polypeptide

SEQ ID NO: 6195 - DNA, 1034 bp, Artificial Sequence; identical to SEQ ID NO: 4670
  Synthetic polypeptide

SEQ ID NO: 6196 - DNA, 1586 bp, Artificial Sequence; identical to SEQ ID NO: 4671
  Synthetic polypeptide

SEQ ID NO: 6197 - DNA, 1588 bp, Artificial Sequence; identical to SEQ ID NO: 4672
  Synthetic polypeptide

SEQ ID NO: 6198 - DNA, 2362 bp, Artificial Sequence; identical to SEQ ID NO: 1664
  Synthetic polypeptide

SEQ ID NO: 6199 - DNA, 2113 bp, Artificial Sequence; identical to SEQ ID NO: 1665
  Synthetic polypeptide

SEQ ID NO: 6200 - DNA, 1399 bp, Artificial Sequence; identical to SEQ ID NO: 1666
  Synthetic polypeptide

SEQ ID NO: 6201 - DNA, 2080 bp, Artificial Sequence; identical to SEQ ID NO: 1667
  Synthetic polypeptide

SEQ ID NO: 6202 - DNA, 2849 bp, Artificial Sequence; identical to SEQ ID NO: 1326
  Synthetic polypeptide

SEQ ID NO: 6203 - DNA, 1925 bp, Artificial Sequence; identical to SEQ ID NO: 1327
  Synthetic polypeptide

SEQ ID NO: 6204 - DNA, 2729 bp, Artificial Sequence; identical to SEQ ID NO: 1328
  Synthetic polypeptide

SEQ ID NO: 6205 - DNA, 2549 bp, Artificial Sequence; identical to SEQ ID NO: 1329
  Synthetic polypeptide

SEQ ID NO: 6206 - DNA, 15330 bp, Artificial Sequence; identical to SEQ ID NO: 1467
  Synthetic polypeptide

SEQ ID NO: 6207 - DNA, 15330 bp, Artificial Sequence; identical to SEQ ID NO: 1468
  Synthetic polypeptide

SEQ ID NO: 6208 - DNA, 15345 bp, Artificial Sequence; identical to SEQ ID NO: 1469
  Synthetic polypeptide

SEQ ID NO: 6209 - DNA, 1743 bp, Artificial Sequence; identical to SEQ ID NO: 1253
  Synthetic polypeptide

SEQ ID NO: 6210 - DNA, 1518 bp, Artificial Sequence; identical to SEQ ID NO: 1254
  Synthetic polypeptide

SEQ ID NO: 6211 - DNA, 1767 bp, Artificial Sequence; identical to SEQ ID NO: 1255
  Synthetic polypeptide

SEQ ID NO: 6212 - DNA, 1052 bp, Artificial Sequence; identical to SEQ ID NO: 247
  Synthetic polypeptide

SEQ ID NO: 6213 - DNA, 327 bp, Artificial Sequence; identical to SEQ ID NO: 246
  Synthetic polypeptide

SEQ ID NO: 6214 - DNA, 1146 bp, Artificial Sequence; identical to SEQ ID NO: 988
  Synthetic polypeptide

SEQ ID NO: 6215 - DNA, 2721 bp, Artificial Sequence; identical to SEQ ID NO: 962
  Synthetic polypeptide

SEQ ID NO: 6216 - DNA, 2549 bp, Artificial Sequence; identical to SEQ ID NO: 963
  Synthetic polypeptide

SEQ ID NO: 6217 - DNA, 559 bp, Artificial Sequence; identical to SEQ ID NO: 1701
  Synthetic polypeptide

SEQ ID NO: 6218 - DNA, 2848 bp, Artificial Sequence; identical to SEQ ID NO: 3654
  Synthetic polypeptide

SEQ ID NO: 6219 - DNA, 157 bp, Artificial Sequence; identical to SEQ ID NO: 1500
  Synthetic polypeptide

SEQ ID NO: 6220 - DNA, 681 bp, Artificial Sequence; identical to SEQ ID NO: 911
  Synthetic polypeptide

SEQ ID NO: 6221 - DNA, 391 bp, Artificial Sequence
  Synthetic polypeptide
atgccccattccgtgaccctgcgcgggccttcgccctggggcttccgcctggtgggcggccgggacttcagcgcgcccctcaccatctcacgggagctagacggatcggcctgaattccactctgtcctgtgacttcccgcttagagccctccatggttcccagccacccaggagaaatgccagcttcccacccgggtgtacaagactctgcaatatctgatccctgcctcttctctgacttcatctctcccactctcccctcactcatgatgctccggccatacaaccttccttcttctttctctccagatatgccattatacatgctggtccttctgcctggaacactatctctccctcagatactctcttttcccttaccccctttgg

SEQ ID NO: 6222 - DNA, 671 bp, Artificial Sequence
  Synthetic polypeptide
atgctatcacataatactatgatgaagcagagaaaacagcaagcaacagccatcatgaaggaagtccatggaaatgatgttgatggcatggacctgggcaaaaaggtcagcatccccagagacatcatgttggaagaattatcccatctcagtaaccgtggtgccaggctatttaagatgcgtcaaagaagatctgacaaatacacatttgaaaatttccagtatcaatctagagcacaaataaatcacagtattgctatgcagaatgggaaagtggatggaagtaacttggaaggtggttcgcagcaagcccccttgactcctcccaacaccccagatccacgaagccctccaaatccagacaacattgctccaggatattctggaccactgaaggaaattcctcctgaaaaattcaacaccacagctgtccctaagtactatcaatctccctgggaacaagccattagcaatgatccggagcttttagaggctttatatcctaaacttttcaagcctgaaggaaaggcagaactgcctgattacaggagctttaacaggggttcaagacttcattggaggaagtaaataaagatctggtggaaatagcaagacaactaaagctagaagtggagtgtggagatgtgactgaattgctgcaatctaaaaaa

SEQ ID NO: 6223 - DNA, 154 bp, Artificial Sequence; identical to SEQ ID NO: 2227
  Synthetic polypeptide

SEQ ID NO: 6224 - DNA, 1747 bp, Artificial Sequence; identical to SEQ ID NO: 1654
  Synthetic polypeptide

SEQ ID NO: 6225 - DNA, 1081 bp, Artificial Sequence; identical to SEQ ID NO: 986
  Synthetic polypeptide

SEQ ID NO: 6226 - DNA, 1054 bp, Artificial Sequence; identical to SEQ ID NO: 987
  Synthetic polypeptide

SEQ ID NO: 6227 - DNA, 137 bp, Artificial Sequence; identical to SEQ ID NO: 2996
  Synthetic polypeptide

SEQ ID NO: 6228 - DNA, 1213 bp, Artificial Sequence; identical to SEQ ID NO: 1093
  Synthetic polypeptide

SEQ ID NO: 6229 - DNA, 616 bp, Artificial Sequence; identical to SEQ ID NO: 1094
  Synthetic polypeptide

SEQ ID NO: 6230 - DNA, 868 bp, Artificial Sequence; identical to SEQ ID NO: 1095
  Synthetic polypeptide

SEQ ID NO: 6231 - DNA, 1737 bp, Artificial Sequence; identical to SEQ ID NO: 4980
  Synthetic polypeptide

SEQ ID NO: 6232 - DNA, 1302 bp, Artificial Sequence; identical to SEQ ID NO: 4981
  Synthetic polypeptide

SEQ ID NO: 6233 - DNA, 1455 bp, Artificial Sequence; identical to SEQ ID NO: 4982
  Synthetic polypeptide

SEQ ID NO: 6234 - DNA, 1734 bp, Artificial Sequence; identical to SEQ ID NO: 4983
  Synthetic polypeptide

SEQ ID NO: 6235 - DNA, 1379 bp, Artificial Sequence; identical to SEQ ID NO: 985
  Synthetic polypeptide

SEQ ID NO: 6236 - DNA, 1063 bp, Artificial Sequence; identical to SEQ ID NO: 2221
  Synthetic polypeptide

SEQ ID NO: 6237 - DNA, 377 bp, Artificial Sequence; identical to SEQ ID NO: 2235
  Synthetic polypeptide

SEQ ID NO: 6238 - DNA, 347 bp, Artificial Sequence; identical to SEQ ID NO: 2236
  Synthetic polypeptide

SEQ ID NO: 6239 - DNA, 4997 bp, Artificial Sequence
  Synthetic polypeptide
atggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgattccattaaattaatgaaagacatttcacagaacttccccataaaagccagatctctaaccagaattgctgtaaatcaacatatgagagaagaaataaaggaaaatcaaaaggatcttcaagttagatttaaaattcagccaggcgatgctcgtctatttataaatggccttcgtgttgatatggatgtttatgacgcttttagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatgtggattaatgacttagaaaatgatgatttgtatattacatggcctacaagttgccagaaacttctgaagccagtatttcctggaagtgtaccttccataaggcgcaattttcataatttggttctgtttattgatccggcccaagaatataccttggattttataaaacttgctgatgttttctattctcacgaagttcctcttagaattggttttgtgttcattcttaatacagatgatgaagttgatggagcaaatgatgctggagttgctctctggcgagctttcaactatattgcagaagaatttgatatatcagaagcatttatttctatagtacacatgtaccaaaaagtgaagaaggatcaaaatatactcactgtggacaatgtgaagagtgttctccaaaatacatttcctcatgctaatatttgggatattttgggaattcattctaaatatgatgaagaaagaaaggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttgggcacattaaatgatcgcacgaatgcaattgattttctaatggataggaataatgttgtaccccgtataaatactttgattttgcgtactaaccagcagtacctcaatttaatatctacatcagtaactgctgatgttgaagatttctctactttctttttcttggattcacaagataagagtgctgtaattgcaaagaacatgtattatttaacccaagacgatgagagtataatttctgcagtcactctctggattattgcagattttgataagccttctgggagaaaacttctttttaatgcattaaagcacatgaaaacaagtgttcatagtcggttggggattatttataatcctacatcaaaaataaatgaagagaacacagctatttctagaggaattttggcagcttttcttacacagaagaacatgtttttgagaagctttcttgggcaactggcaaaggaagaaattgctacagctatttactctggagataaaattaaaacattccttattgaggggatggataagaatgcttttgagaaaaaatataatactgttggagtgaatatttttcgaactcaccagttgttctgtcaagatgtacttaaattacgtcctggagaaatgggtattgtcagcaatgggagattcttaggacctttagatgaagatttttatgcagaagatttttacttgttggaaaagataacatttagtaatttaggagagaaaattaaaggcattgttgaaaatatgggaatcaacgcaaataacatgagtgactttattatgaaagttgatgcccttatgtcctctgtgcctaagcgtgcatctcgatatgatgtcacatttcttagggagaatcacagtgttataaagacgaatcctcaagagaatgatatgttcttcaatgtcattgctattgttgatccattaacaagagaagcacagaaaatggcacagttgttggttgtacttggcaagattatcaacatgaagataaagttgttcatgaactgtaggggcaggctttcagaagcccctttagaaagcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgggtattttcaattaaaagcaaacccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaagtgaaaaaagaaacagacaaaattaaggaagatatccttaccgatgaagatgaaaaaacaaaaggactgtgggattccattaaaagtttcacagtaagcttgcataaagaaaacaaaaaggaaaaagatgtcctaaacattttttcagttgcttctggtcatttatatgaacgttttttaagaattatgatgctttctgttttgcgtaacaccaaaacaccagtgaaattctggttgctaaaaaattatctctcaccgacatttaaagaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccagattgtgagacatgatctaaaagaacttcgagatttcgatctggatggagctccttatgggtatactccattttgtgatagccgcagggaaatggatggatatcgtttctggaaaacaggatactgggcatcacatcttttaagacggaaataccatatcagtgctttatatgtagtggatctcaagaagttcaggagaattggagcaggtgacaggctcaggagccagtatcaagctctcagtcaagatccaaacagtctttcaaacctagatcaggaagtgaggagcgtctctgcccggccgcccatcatctgggatgtggggagcgcctctgccccgccaccccgccaccccgtctgagatgtgaagagcgcctctgcccggccgcgaccccgtctgggaactgaggagtgtctctgccccgccgccaccccgtctgggaagtgaggagcgtctctgaccagccgccaccctgtctgggaggtgtacccaacagctcattgagaacgggccatgatgacgatggcggttttgtcgaatagaaaagggggaaatgtggggaaaagaaagagagatcagattgttactgtgtctgtgtagaaagaagtagacataggagactccattttgttctgtactaagaaaaattcttctgccttgggatgctgttaatctataaccttacccccaaccccgtgctctctgaaacatgtgctttgtccactaagggttaaatggattaagggcggtgcaagatgtgctttgttaaacagatgcttgaaggcagcataccagtcatcaccactccctaatctcaagtacccagggacacaaacactgcggaaggcggcagggccctctgcctaggaaaaccagagacctttgttcacaagtttatctgctgaccttccctccactattgtcctatgaccccgccaaatcccgctctccgagaaacacccaagaatgatcaataaatactaaaaaaa

SEQ ID NO: 6240 - DNA, 569 bp, Artificial Sequence; identical to SEQ ID NO: 1768
  Synthetic polypeptide

SEQ ID NO: 6241 - DNA, 497 bp, Artificial Sequence; identical to SEQ ID NO: 1769
  Synthetic polypeptide

SEQ ID NO: 6242 - DNA, 338 bp, Artificial Sequence
  Synthetic polypeptide
atgatggcagaagagcacacagatctcgaggcccagatcgtcaaggatatccactgcaaggagattgacctggtgaaccgagaccccaagaacattaacgaggacatagtcaagactggagaaaatggaaaaagagaataccccggaggaatctgaagctctcaaacacttctggtaagaatgcattttggagtagcctccttcaaaggaagaaatttaacaatatatataaattgcctttaaaatgtgcatgccttttgacacagtaattaacccttctaatgatgtaacttgaggaaatgattgggcaaaaatgcaaagaggtatgtatacagatg

SEQ ID NO: 6243 - DNA, 1898 bp, Artificial Sequence; identical to SEQ ID NO: 2282
  Synthetic polypeptide

SEQ ID NO: 6244 - DNA, 1865 bp, Artificial Sequence; identical to SEQ ID NO: 2283
  Synthetic polypeptide

SEQ ID NO: 6245 - DNA, 764 bp, Artificial Sequence; identical to SEQ ID NO: 2284
  Synthetic polypeptide

SEQ ID NO: 6246 - DNA, 5018 bp, Artificial Sequence; identical to SEQ ID NO: 4912
  Synthetic polypeptide

SEQ ID NO: 6247 - DNA, 5270 bp, Artificial Sequence; identical to SEQ ID NO: 4913
  Synthetic polypeptide

SEQ ID NO: 6248 - DNA, 67 bp, Artificial Sequence; identical to SEQ ID NO: 5156
  Synthetic polypeptide

SEQ ID NO: 6249 - DNA, 575 bp, Artificial Sequence; identical to SEQ ID NO: 5160
  Synthetic polypeptide

SEQ ID NO: 6250 - DNA, 1412 bp, Artificial Sequence; identical to SEQ ID NO: 5151
  Synthetic polypeptide

SEQ ID NO: 6251 - DNA, 434 bp, Artificial Sequence; identical to SEQ ID NO: 992
  Synthetic polypeptide

SEQ ID NO: 6252 - DNA, 860 bp, Artificial Sequence; identical to SEQ ID NO: 2285
  Synthetic polypeptide

SEQ ID NO: 6253 - DNA, 1823 bp, Artificial Sequence; identical to SEQ ID NO: 2286
  Synthetic polypeptide

SEQ ID NO: 6254 - DNA, 1796 bp, Artificial Sequence; identical to SEQ ID NO: 2287
  Synthetic polypeptide

SEQ ID NO: 6255 - DNA, 875 bp, Artificial Sequence; identical to SEQ ID NO: 5161
  Synthetic polypeptide

SEQ ID NO: 6256 - DNA, 2497 bp, Artificial Sequence; identical to SEQ ID NO: 5224
  Synthetic polypeptide

SEQ ID NO: 6257 - DNA, 2569 bp, Artificial Sequence; identical to SEQ ID NO: 5225
  Synthetic polypeptide

SEQ ID NO: 6258 - DNA, 1178 bp, Artificial Sequence; identical to SEQ ID NO: 1256
  Synthetic polypeptide

SEQ ID NO: 6259 - DNA, 947 bp, Artificial Sequence; identical to SEQ ID NO: 1257
  Synthetic polypeptide

SEQ ID NO: 6260 - DNA, 857 bp, Artificial Sequence; identical to SEQ ID NO: 1258
  Synthetic polypeptide

SEQ ID NO: 6261 - DNA, 550 bp, Artificial Sequence; identical to SEQ ID NO: 3092
  Synthetic polypeptide

SEQ ID NO: 6262 - DNA, 412 bp, Artificial Sequence; identical to SEQ ID NO: 3093
  Synthetic polypeptide

SEQ ID NO: 6263 - DNA, 18 bp, Artificial Sequence
  Synthetic polypeptide
atgttagcatttaagaga

SEQ ID NO: 6264 - DNA, 318 bp, Artificial Sequence
  Synthetic polypeptide
atggcccaagccctgccctggctcctgctgtggatgggcgcgggagtgctgcctgcccacggcacccagcacggcatccggctgcccctgcgcagcggcctggggggcgcccccctggggctgcggctgccccgggagaccgacgaagagcccgaggagcccggccggaggggcagctttgtggagatggtggacaacctgaggggcaagtcggggcagggctactacgtggagatgaccgtgggcagccccccgcagacgttggtttttcagcagacctgcagagggcacaggggaagtgttcctttggcccctgca

SEQ ID NO: 6265 - DNA, 15330 bp, Artificial Sequence; identical to SEQ ID NO: 1467
  Synthetic polypeptide

SEQ ID NO: 6266 - DNA, 15330 bp, Artificial Sequence; identical to SEQ ID NO: 1468
  Synthetic polypeptide

SEQ ID NO: 6267 - DNA, 15345 bp, Artificial Sequence; identical to SEQ ID NO: 1469
  Synthetic polypeptide

SEQ ID NO: 6268 - DNA, 154 bp, Artificial Sequence; identical to SEQ ID NO: 2227
  Synthetic polypeptide

SEQ ID NO: 6269 - DNA, 637 bp, Artificial Sequence
  Synthetic polypeptide
atgttccagaacctgcaaggaacatttgaaaaggaaattggaaaaataattccatttaccatagcatttaagagagctgaggctgtggagccagatggctgcgttcagagctggcgctgctgtttaccatgtgaccttggacaagcttctcgcttcattcataccacagtttgttcggctattaggtggaggagctgtaagggggagaggaactttgctgaaaggcacatcctccctgcagagcttgaagaacaatctaaccatgctggcatggggcccatcctacctgcaatgccaagaccctgcacttgatggatcagctcagtaaactgactcatctgatcttgtggccccttctcaggaactgactcagcacaagaagacagcttcgactccctatgatttcatctctgaccaatcagcactcctggcacactggcttcccccaacccaccaagttatccttaaaaactccattccctgattgctaggggagacagatttgagtaataataaaactccggtctcccccacagctggctctgcacgaattactcttcttctattgcaattcccctgtcttgatgaatcggctctgtctaggcagcaggcaaggtgaaccctttgagcagttaca

SEQ ID NO: 6270 - DNA, 767 bp, Artificial Sequence; identical to SEQ ID NO: 937
  Synthetic polypeptide

SEQ ID NO: 6271 - DNA, 677 bp, Artificial Sequence; identical to SEQ ID NO: 938
  Synthetic polypeptide

SEQ ID NO: 6272 - DNA, 802 bp, Artificial Sequence; identical to SEQ ID NO: 2212
  Synthetic polypeptide

SEQ ID NO: 6273 - DNA, 2141 bp, Artificial Sequence; identical to SEQ ID NO: 2213
  Synthetic polypeptide

SEQ ID NO: 6274 - DNA, 2192 bp, Artificial Sequence; identical to SEQ ID NO: 2214
  Synthetic polypeptide

SEQ ID NO: 6275 - DNA, 2015 bp, Artificial Sequence; identical to SEQ ID NO: 2215
  Synthetic polypeptide

SEQ ID NO: 6276 - DNA, 2109 bp, Artificial Sequence
  Synthetic polypeptide
atggccccgctggttccaggacctcccctcgaagcctcacccaccaccctggatgcagcagtcagatgggggcttcagaggccggtgcgcggccacatggccccgggccaggcagggggtcgtggggacgcatctgcgctaggcgcacagtattcctgggcgcgggacgggcgaagcgccgtgggttccaagctgagctgggtcggccctgcagcgccggagagcaaggcggcgcagggaagggagatggggcgggatgtggggaaagctgtcgactgcttggatctctccggcccggatggcgccagctgcctccagctcagcctgcggaaatccgagctcttcccagcggcccgacggcccgggcgccccgcagaccctgggctctccccgcggtgcctccgccgcccgcccctgcgtcctggcccggcctccacgcccctccgaggtcccggcgcagcgcggccgccgccactccccccacattccagaggccgcagcgccgtctccttcctcgcattcctgcccccgcaaaggagtccctccgccccgcgcgaggccgcggggtcccggggcgggctccgggcttcgggcggacgatgcggcggcccggccggagcggcggcgggaagcggaggcggaggtgacgcgccagggccggcgggccgggccatgcagcgctccagggcgggcgcggacgaggcggccctactcctggccgggctggccctgcgggagctggagcccgggtgcggctctcccggtcgggggcggcgggggccgcggcctgggcctggagacgaggcggcgcccgcgctgggccgcagagggaagggcagcggcggccccgaggccggggcggacggactgagccgcggggagcggggtccccggcgcgcggcggttccggagctcagcgcgcagcctgcgggcagcccacgggccagcctggcggggtccgacggcggcggcggtggcggcagcgcccgatccagcggcatcagcctgggctacgaccagcgccacggcagcccgcgctccggtcgctcggacccgcgtcccggtcccgggccgccttcggtgggcagcgcccgctccagcgtttccagcctcggctcccggggctcggccggcgcctacgctgacttcctcccgcccggcgcctgccccgcgcccgctcgctccccggagcctgcggggccggctcccttcccgctgcctgcactcccgctgccccctggccgggagggcggcccaagcgcggccgagcggcggctggaggcgctcacccgggagctggagcgggcgctcgaggcgcgcacggcgcgggactacttcggcatttgcatcaagtgtgggcttggcatctacggagcccagcaggcgtgccaggcaatggggagtctttatcacactgactgcttcacctgcgactcgtgtgggagacgactccgtgggaaggcgttctacaacgtgggtgagaaagtgtactgccaggaggacttcctgtactccgggttccagcagacggccgacaaatgcagcgtgtgtggacatctcatcatggaaatgatcctgcaggccctgggcaagtcctaccacccaggctgcttccggtgctccgtgtgcaatgagtgcctggacggggttcccttcaccgtggacgtggagaacaacatctactgcgtgcgagactatcacacggtttttgcaccaaaatgcgcctcctgtgcccgtcctatcctccctgcacagggctgcgagacaaccatccgtgtggtgtccatggacagagactaccacgtggcatgttaccactgtgaggctcggtggttcatgcctgtaatcccagcactttgggaggctgaggagggtggatcacctgaggtcaggagttcgagaccagcctggccaacatggtgaaaccccgtctctactaaaaatacaaaaattagccaggcgtggtggcgggcacctgtagtcccagctactcaggaggctgaggtaggagaatcgcttgaacctgggaggcagaggttgcagtgagccgagattgtgccattgcactccagcctgggcaacaagagtgagactctgtctcaaaaaaaa

SEQ ID NO: 6277 - DNA, 1437 bp, Artificial Sequence
  Synthetic polypeptide
atgcagcgctccagggcgggcgcggacgaggcggccctactcctggccgggctggccctgcgggagctggagcccgggtgcggctctcccggtcgggggcggcgggggccgcggcctgggcctggagacgaggcggcgcccgcgctgggccgcagagggaagggcagcggcggccccgaggccggggcggacggactgagccgcggggagcggggtccccggcgcgcggcggttccggagctcagcgcgcagcctgcgggcagcccacgggccagcctggcggggtccgacggcggcggcggtggcggcagcgcccgatccagcggcatcagcctgggctacgaccagcgccacggcagcccgcgctccggtcgctcggacccgcgtcccggtcccgggccgccttcggtgggcagcgcccgctccagcgtttccagcctcggctcccggggctcggccggcgcctacgctgacttcctcccgcccggcgcctgccccgcgcccgctcgctccccggagcctgcggggccggctcccttcccgctgcctgcactcccgctgccccctggccgggagggcggcccaagcgcggccgagcggcggctggaggcgctcacccgggagctggagcgggcgctcgaggcgcgcacggcgcgggactacttcggcatttgcatcaagtgtgggcttggcatctacggagcccagcaggcgtgccaggcaatggggagtctttatcacactgactgcttcacctgcgactcgtgtgggagacgactccgtgggaaggcgttctacaacgtgggtgagaaagtgtactgccaggaggacttcctgtactccgggttccagcagacggccgacaaatgcagcgtgtgtggacatctcatcatggaaatgatcctgcaggccctgggcaagtcctaccacccaggctgcttccggtgctccgtgtgcaatgagtgcctggacggggttcccttcaccgtggacgtggagaacaacatctactgcgtgcgagactatcacacggtttttgcaccaaaatgcgcctcctgtgcccgtcctatcctccctgcacagggctgcgagacaaccatccgtgtggtgtccatggacagagactaccacgtggcatgttaccactgtgaggctcggtggttcatgcctgtaatcccagcactttgggaggctgaggagggtggatcacctgaggtcaggagttcgagaccagcctggccaacatggtgaaaccccgtctctactaaaaatacaaaaattagccaggcgtggtggcgggcacctgtagtcccagctactcaggaggctgaggtaggagaatcgcttgaacctgggaggcagaggttgcagtgagccgagattgtgccattgcactccagcctgggcaacaagagtgagactctgtctcaaaaaaaa

SEQ ID NO: 6278 - DNA, 884 bp, Artificial Sequence
  Synthetic polypeptide
tcccgctgccccctggccgggagggcggcccaagcgcggccgagcggcggctggaggcgctcacccgggagctggagcgggcgctcgaggcgcgcacggcgcgggactacttcggcatttgcatcaagtgtgggcttggcatctacggagcccagcaggcgtgccaggcaatggggagtctttatcacactgactgcttcacctgcgactcgtgtgggagacgactccgtgggaaggcgttctacaacgtgggtgagaaagtgtactgccaggaggacttcctgtactccgggttccagcagacggccgacaaatgcagcgtgtgtggacatctcatcatggaaatgatcctgcaggccctgggcaagtcctaccacccaggctgcttccggtgctccgtgtgcaatgagtgcctggacggggttcccttcaccgtggacgtggagaacaacatctactgcgtgcgagactatcacacggtttttgcaccaaaatgcgcctcctgtgcccgtcctatcctccctgcacagggctgcgagacaaccatccgtgtggtgtccatggacagagactaccacgtggcatgttaccactgtgaggctcggtggttcatgcctgtaatcccagcactttgggaggctgaggagggtggatcacctgaggtcaggagttcgagaccagcctggccaacatggtgaaaccccgtctctactaaaaatacaaaaattagccaggcgtggtggcgggcacctgtagtcccagctactcaggaggctgaggtaggagaatcgcttgaacctgggaggcagaggttgcagtgagccgagattgtgccattgcactccagcctgggcaacaagagtgagactctgtctcaaaaaaaa

SEQ ID NO: 6279 - DNA, 806 bp, Artificial Sequence; identical to SEQ ID NO: 974
  Synthetic polypeptide

SEQ ID NO: 6280 - DNA, 591 bp, Artificial Sequence
  Synthetic polypeptide
atgcagcagagaggactcgccatcgtggccttggctgtctgtgcggccctacatgcctcagaagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtcctgcatactgatgaaactactgatgtcagctggtctgaaggaccctaccagaagctaaatcatcaaagaatgcaatttccatatcctaatgattcaatctcccttaccctgaccaatcagtggcccaaattttccagccccttgcctcccagaaccccagcccagaactcttcagagatttaagaatctcctcctacctcctgactcagcaccatgtaatcattaaactctctgctgcaaactctgctgtctcaatgtatcagtctgttactgcacagtgggtgtatgaacctgttggtcttatgaca

SEQ ID NO: 6281 - DNA, 450 bp, Artificial Sequence
  Synthetic polypeptide
atgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtcctgcatactgatgaaactactgatgtcagctggtctgaaggaccctaccagaagctaaatcatcaaagaatgcaatttccatatcctaatgattcaatctcccttaccctgaccaatcagtggcccaaattttccagccccttgcctcccagaaccccagcccagaactcttcagagatttaagaatctcctcctacctcctgactcagcaccatgtaatcattaaactctctgctgcaaactctgctgtctcaatgtatcagtctgttactgcacagtgggtgtatgaacctgttggtcttatgaca

SEQ ID NO: 6282 - DNA, 1177 bp, Artificial Sequence
  Synthetic polypeptide
atggggctcccgcgcgggtcgttcttctggctgctgctcctgctcacggctgcctgctcggggctcctctttgccctgtacttctcggcggtgcagcggtacccggggccagcggccggagccagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggccgcacgcctattttggaccagaagcctctgccagtaaattcaagctgctacatccggacttcatcagctacctgacagaaaggttcttgaaatcaaagttgattaacacacattttggagacctatatatgcctagtaccggggctctcatgctgctgacagctttgcatacctgtgaccagaaggtacgcgcctgtagtcccagcactcaggaggctgagccaggagaattgcttgaacccgggaggtggaggttgcagtgagccaagattgtaccacttcactccagcctggcgacagagtggaactccgtctcaaaaaataaaataaaataaaataaaataaaataaaataaaataaaataaagcaaaaatataaaatgttaaaaaaaaaacaaaaaaa

SEQ ID NO: 6283 - DNA, 718 bp, Artificial Sequence
  Synthetic polypeptide
ctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggttcttgaaatcaaagttgattaacacacattttggagacctatatatgcctagtaccggggctctcatgctgctgacagctttgcatacctgtgaccagaaggtacgcgcctgtagtcccagcactcaggaggctgagccaggagaattgcttgaacccgggaggtggaggttgcagtgagccaagattgtaccacttcactccagcctggcgacagagtggaactccgtctcaaaaaataaaataaaataaaataaaataaaataaaataaaataaaataaagcaaaaatataaaatgttaaaaaaaaaacaaaaaaa

SEQ ID NO: 6284 - DNA, 220 bp, Artificial Sequence
  Synthetic polypeptide
atggtgggccccgcgccgcggcggcggctgcggccgctggcagcgctggccctggtcctggcgctggccccggggctgcccacagcccgggccgggcagacaccgcgccctgccgagcgggggcccccagtgcggcttttcaccgaggaggagctggcccgctatggcggggaggagggactctccaactgacccgatgatctttgggaccactggcaca

SEQ ID NO: 6285 - DNA, 1288 bp, Artificial Sequence; identical to SEQ ID NO: 2642
  Synthetic polypeptide

SEQ ID NO: 6286 - DNA, 625 bp, Artificial Sequence; identical to SEQ ID NO: 2643
  Synthetic polypeptide

SEQ ID NO: 6287 - DNA, 700 bp, Artificial Sequence; identical to SEQ ID NO: 2644
  Synthetic polypeptide

SEQ ID NO: 6288 - DNA, 778 bp, Artificial Sequence; identical to SEQ ID NO: 2645
  Synthetic polypeptide

SEQ ID NO: 6289 - DNA, 238 bp, Artificial Sequence; identical to SEQ ID NO: 2646
  Synthetic polypeptide

SEQ ID NO: 6290 - DNA, 107 bp, Artificial Sequence; identical to SEQ ID NO: 5502
  Synthetic polypeptide

SEQ ID NO: 6291 - DNA, 697 bp, Artificial Sequence
  Synthetic polypeptide
atggcggacgagaaggacagggaagagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttac

SEQ ID NO: 6292 - DNA, 1105 bp, Artificial Sequence
  Synthetic polypeptide
atgctaggcccgggacaagtccggctccggcctcgggtctggagggacaaggccgggggccgggtggcagacggggcctctggtcttcccccagcgcgagggtcgtggcgcgaaacggggacagggcgcgcgctcggagcctcctccccgccccgccccgcccaagggtcttcctcccccgggattcagagcggcccctcctccaggccaggctcgccgcggggcgctgagcaggccgggacaccgcggccgaggttatcgttaggcatctcccaggcgaccggctccgcagcaagatggcggacgagaaggacagggaagggcctgggatacaacagtgatgagataaggcctcggactttactgatcgaacatctaatggaaggtggaagaagagaccatcacacaatgacggtgttatggggaacacaggagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttac

SEQ ID NO: 6293 - DNA, 872 bp, Artificial Sequence
  Synthetic polypeptide
ggccgggacaccgcggccgaggttatcgttaggcatctcccaggcgaccggctccgcagcaagatggcggacgagaaggacagggaagggcctgggatacaacagtgatgagataaggcctcggactttactgatcgaacatctaatggaaggtggaagaagagaccatcacacaatgacggtgttatggggaacacaggagataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttac

SEQ ID NO: 6294 - DNA, 672 bp, Artificial Sequence
  Synthetic polypeptide
agataatagtagcagaatttcacaaaaaaatcaaagaggcatttgaagtctttgaccatgagtcgaataatacagtggatgtgagagagattggaacaattatcaggtcattaggatgctgtcctacggaaggagagctgcatgatctgattgcagaggtagaggaagaagaacccactggatacattcgattcgaaaaatttcttccggtgatgacagaaatactactagaaagaaaatacagaccaattccagaagatgtccttcttcgagcttttgaggttttagattcagctaaacgtgggtttcttactaaggacgagctgatcaagtatatgactgaagaagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttac

SEQ ID NO: 6295 - DNA, 420 bp, Artificial Sequence
  Synthetic polypeptide
cagaagatgtccttcttcgagcttttgaggttttagattcagctaaacgtgggtttcttactaaggacgagctgatcaagtatatgactgaagaagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttac

SEQ ID NO: 6296 - DNA, 1081 bp, Artificial Sequence; identical to SEQ ID NO: 986
  Synthetic polypeptide

SEQ ID NO: 6297 - DNA, 1054 bp, Artificial Sequence; identical to SEQ ID NO: 987
  Synthetic polypeptide

SEQ ID NO: 6298 - DNA, 1689 bp, Artificial Sequence; identical to SEQ ID NO: 964
  Synthetic polypeptide

SEQ ID NO: 6299 - DNA, 1671 bp, Artificial Sequence; identical to SEQ ID NO: 965
  Synthetic polypeptide

SEQ ID NO: 6300 - DNA, 650 bp, Artificial Sequence; identical to SEQ ID NO: 966
  Synthetic polypeptide

SEQ ID NO: 6301 - DNA, 798 bp, Artificial Sequence; identical to SEQ ID NO: 3839
  Synthetic polypeptide

SEQ ID NO: 6302 - DNA, 573 bp, Artificial Sequence; identical to SEQ ID NO: 1369
  Synthetic polypeptide

SEQ ID NO: 6303 - DNA, 416 bp, Artificial Sequence; identical to SEQ ID NO: 1370
  Synthetic polypeptide

SEQ ID NO: 6304 - DNA, 77 bp, Artificial Sequence; identical to SEQ ID NO: 1778
  Synthetic polypeptide

SEQ ID NO: 6305 - DNA, 2079 bp, Artificial Sequence
  Synthetic polypeptide
atgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggaacttcccacagat

SEQ ID NO: 6306 - DNA, 2076 bp, Artificial Sequence
  Synthetic polypeptide
atgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggaacttcccacagat

SEQ ID NO: 6307 - DNA, 2101 bp, Artificial Sequence
  Synthetic polypeptide
atgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggacactgtgcagcttcgcacctccaagcctttgcttctgcatcgcctgacacttggagcacccttctccactt

SEQ ID NO: 6308 - DNA, 2185 bp, Artificial Sequence
  Synthetic polypeptide
atgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatgtgtgtgcacggcagggggcgtctgcaggtacagagtggggtgctggggcaggcccgcactgggcttcatccccactcgggacaggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggacactgtgcagcttcgcacctccaagcctttgcttctgcatcgcctgacacttggagcacccttctccactt

SEQ ID NO: 6309 - DNA, 2134 bp, Artificial Sequence
  Synthetic polypeptide
atggccttcgtctgtgccggcttatccgacaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggacactgtgcagcttcgcacctccaagcctttgcttctgcatcgcctgacacttggagcacccttctccactt

SEQ ID NO: 6310 - DNA, 2239 bp, Artificial Sequence
  Synthetic polypeptide
atgaacacatctggagacccagcccagacgggccctgaaggctgtagaggcaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatgtgtgtgcacggcagggggcgtctgcaggtacagagtggggtgctggggcaggcccgcactgggcttcatccccactcgggacaggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggacactgtgcagcttcgcacctccaagcctttgcttctgcatcgcctgacacttggagcacccttctccactt

SEQ ID NO: 6311 - DNA, 2155 bp, Artificial Sequence
  Synthetic polypeptide
atgaacacatctggagacccagcccagacgggccctgaaggctgtagaggcaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggacactgtgcagcttcgcacctccaagcctttgcttctgcatcgcctgacacttggagcacccttctccactt

SEQ ID NO: 6312 - DNA, 1705 bp, Artificial Sequence; identical to SEQ ID NO: 1155
  Synthetic polypeptide

SEQ ID NO: 6313 - DNA, 1356 bp, Artificial Sequence; identical to SEQ ID NO: 5183
  Synthetic polypeptide

SEQ ID NO: 6314 - DNA, 1157 bp, Artificial Sequence
  Synthetic polypeptide
atggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtaactttgcattctaatggaccaactggtaccacccaaatcggtaagccacacaaagaaactgactcaagtggtcctgtgaaccccccatcgaggaactgactcagcacaagaagacagttttgacatccgtatggttttatccccaacccaacaaagcagcatttctcattccctagccccttgcttgtcaaaccatccttgaaaaaccctagcctctgaattctctatgggtaggatttaagaattatctcccgtcctcctcatgcagctgccctgtgattattaaactctttctctgctacaactcctactgtctcagggtactggctttttctgggtggcaggcaagaagaaccca

SEQ ID NO: 6315 - DNA, 1019 bp, Artificial Sequence
  Synthetic polypeptide
atgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtaactttgcattctaatggaccaactggtaccacccaaatcggtaagccacacaaagaaactgactcaagtggtcctgtgaaccccccatcgaggaactgactcagcacaagaagacagttttgacatccgtatggttttatccccaacccaacaaagcagcatttctcattccctagccccttgcttgtcaaaccatccttgaaaaaccctagcctctgaattctctatgggtaggatttaagaattatctcccgtcctcctcatgcagctgccctgtgattattaaactctttctctgctacaactcctactgtctcagggtactggctttttctgggtggcaggcaagaagaaccca

SEQ ID NO: 6316 - DNA, 1167 bp, Artificial Sequence
  Synthetic polypeptide
gagtctagcttatggttaaaaacctatgtgtgatgtttcagacctgaccataaacaattacagactttacctaggaggccacatggggaaaagctgccctccctacaccagacttggcgtactgccaatgcattacagtttctaaagggagttgcagtcaaggactcagggccccctgttagtcatgctcttgtaacagtatttgcattgagagtcctggcactttcattcttaggtctctctatctgaggccatgggccaaggtcttcttcaggcacctctgccaaggcctgtttatgcaagaaggagtggaaaaaccttgacatttttttccactgtgactcactacccagtacttttccacccttagcccccttcctttgcacccatacccccaagatccatcaaactgctaaagcctttttttccaagctccttcaacagtgaaccaaccctcatgtctgtgtggatccagctgactcttgactagattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccgacatggggagagggagtcttgctgtgttgcccaagctggtcttga

SEQ ID NO: 6317 - DNA, 1266 bp, Artificial Sequence
  Synthetic polypeptide
gagtctagcttatggttaaaaacctatgtgtgatgtttcagacctgaccataaacaattacagactttacctaggaggccacatggggaaaagctgccctccctacaccagacttggcgtactgccaatgcattacagtttctaaagggagttgcagtcaaggactcagggccccctgttagtcatgctcttgtaacagtatttgcattgagagtcctggcactttcattcttaggtctctctatctgaggccatgggccaaggtcttcttcaggcacctctgccaaggcctgtttatgcaagaaggagtggaaaaaccttgacatttttttccactgtgactcactacccagtacttttccacccttagcccccttcctttgcacccatacccccaagatccatcaaactgctaaagcctttttttccaagctccttcaacagtgaaccaaccctcatgtctgtgtggatccagctgactcttgactagattatgaagaagctgtgctcttgctgttagaaggagctgcctgggaagaagctttgaggctggtatacaaatataacagactggatattatagaaaccaacgtaaagccttccattttagaagcccagaaaaattatatggcatttctggactctcagacagccacattcagtcgccacaagaaacgtttattggtagttcgagagctcaaggagcaagcccagcaggcaggtctggatgatgaggtaccccacgggcaagagtcagacctcttctctgaaactagcagtgtcgtgagtggcagtgagatgagtggcaaatactcccatagtaactccaggatatcagcgagatcatccaagaatcgccgaaaagcggagcggaagaagcacagcctcaaagaaggcagtccgctggaggacctggccctcctggaggcactgagtgaagtggtgcagaacactgaaaacctgaaagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggttctaggtcccaattctactgcaaatagtatcatggcatcttatcagcaacagaagacttcggttcctgttcttgatgctgagctttttataccaccaaagatcaacagaagaacccagtggaagctgagcctgctagactga

SEQ ID NO: 6318 - DNA, 406 bp, Artificial Sequence
  Synthetic polypeptide
gttattgtgtttatttggagaatctccattacaagctcataatgaatcagacatcacagaagaaagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccaggtga

SEQ ID NO: 6319 - DNA, 908 bp, Artificial Sequence
  Synthetic polypeptide
gttattgtgtttatttggagaatctccattacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttga

SEQ ID NO: 6320 - DNA, 710 bp, Artificial Sequence
  Synthetic polypeptide
gttattgtgtttatttggagaatctccattacaagctcataatgaatcagacatcacagaagaaagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttga

SEQ ID NO: 6321 - DNA, 560 bp, Artificial Sequence
  Synthetic polypeptide
tgatgtggtttgactgtgtccccactcacatctcatcttgaattcccacatgttgtgggagggacccagtgggaggtagttgaatcatgggggcaggcctttcctgtgctgttctggtggtgacgaatgagtctcacgggatctgatgattatataagggggagtttccctgcacaagctctcatctggtctgctgccatgtgaggtgtgcctttcaccttctgccatgattgtgaagcctccccaccacatggaacggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtga

SEQ ID NO: 6322 - DNA, 560 bp, Artificial Sequence
  Synthetic polypeptide
acttggagttaggatccccaggttctagtcctgagtctggactctggatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctag

SEQ ID NO: 6323 - DNA, 138 bp, Artificial Sequence
  Synthetic polypeptide
gcctcagattccttatatgtaagatcacggttgggctgccaaatctgtttgacaaaatctatggacaatatgactgttcgagtgcctgaaacagtggctgatgccagacaatccattgatgtgggcaagacctcctga

SEQ ID NO: 6324 - DNA, 171 bp, Artificial Sequence
  Synthetic polypeptide
ggccaggcatggtgtctcacgcctggaatcccagcgctttgggaggctgagggtcctgaggacaccgtgagccagccaggcctggccgctgggcctgaccggccccccagcccctacaccccgcttctcccggactctcccagcggacagccccccagccccacagcctga

SEQ ID NO: 6325 - DNA, 59 bp, Artificial Sequence
  Synthetic polypeptide
ggccaggcatggtgtctcacgcctggaatcccagcgctttgggaggctgagggtcctga

SEQ ID NO: 6326 - DNA, 231 bp, Artificial Sequence
  Synthetic polypeptide
acgaggctttgaaagcctcggacaggacaggtgcgtcctgtctaactcgccagtggccctgggcgagcttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataa

SEQ ID NO: 6327 - DNA, 147 bp, Artificial Sequence
  Synthetic polypeptide
aagacagacaataacaagtgttgctgacggtgtggagaaattggaaccctcatacattgcaggaggccagatgctccagtgcctgatggcgaaagtgagaaaactgtagaagaaagttcagatagcgaatcttcttttagtgattaa

SEQ ID NO: 6328 - DNA, 1651 bp, Artificial Sequence
  Synthetic polypeptide
caggacagttttctgggtggccttggcctcctttcctcacttgaagttcttaagaataactataaaatgtgctgggaatgcaacattctgagataaaggaggagctggccagaacagcctactctctgtgccagtcttcccccacccacaaaacaggatgtccttcagtgctttagcctagcacgtcctttgatctcagaacatcaaacccaggtggactgctttctggggttcttcagctgctgtgcaagtgtggcatatgaagacttcatttgccctgggcagctttcctgagccttacgggaccagttcacaatgaatcctaggcttctgttgtcccttgttacctatcttctcagctgtttcagttccgggaatgacagatacctcagtcttggaccaatggaaagcaagtttctttgtggaggatttccttgagaaaaaaacaattacaagaatggtgacccagattaattgtgaatttgaggaagttgttccaagttcaaatccagactcccaaattgaagtagaggaggtcagtttatacacccacatggactacaatgaagtctttacccctgtcagttgtttagaaaaatgttcagcacttcaaaaccagaaccaagatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgagccgtcaagttttcttattgagtatgaattcttaatacctccaagcctcaaaccagaaattgatattccatcactctcagaactgaaggagttattaaacccagtgccagaaataataaactatgtagatgaaaaggaaaagctttttgaaagagatcttactaacaagcatggaattgaggatatcggggatataaaattcagctccacagagattttgaccattcaaagccagagtgaaccagaagagtgcagtaaaccaggagagttagaaatgccactaactcctctattcctaacatgccaacattcttcagtgaattcattacgtacagaacttcagacatttccattatctccggtttgtaaaattaatttgcttactgctgaagaatcagctaatgaatactacatgatgtggcaattagaaagatgtagaagccctttgaacccatttttgcttacagtgccaagaattcaagagccccacagccaatattcagttacagatttgaaaaagatattttctgttaaagaagaaagccttgtgattaatctggaaaaggcagagtggtggaaacaagcaggactaaatctgaaaatgatggaaacattggaacatctgaatacatatttatgtcatgataatttgtcttctaatgacactaaaattgagatatttttgcctacgaaagtgcttcaattagaatgtaagtacatcacagtaaatattagttatgtaaacattttcagaatgtga

SEQ ID NO: 6329 - DNA, 376 bp, Artificial Sequence
  Synthetic polypeptide
caggtgggcagtaagtgggtgggtcataggaagaaaagtgatcttcagtcaggagacttgggttctgggctctgtctgatgactggctctgtgatgtgagccaggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaa

SEQ ID NO: 6330 - DNA, 1214 bp, Artificial Sequence
  Synthetic polypeptide
gcaaaggcagtcaggtttatgatcaggactgcccttatctgtaaagctgctaacccccgagcctggaagggaaaagattaacaccagctgccaggcttttggttgtaccatacaacaagaaggcttggacaaggagaacactttttctggattggttccattgtcgatttgtccctgaagttaagtagtatcttgccagtaaggggactgccttttaaagttcttttgatactggagaatgcccgaggccaccccaaactccatgagttcaacaccgaagacattgaagtgatctacttgcccccaaacacacatctctaattcagcctctagatcagggtgtcataaggacctttaaggctcgttacaaacagtactctatagaaaggattgtcaaatgtatggaaaagaaccttgacagaacatgaaagtctgaaagaattacaccatcaatgatgccatcattgttatagaaaaagctgtgaaagccatcaagcccaggacaataaattcctgctagagaaaactgtgtccagatgtgcatgacttcacaggctttacgacagccaatcaaggaaatcatgaaaaagattgtggatctggcacaaaaaaaaaaaaaaaaaaaaaaaatggtgcatgaaggatttcaagataggaatcttggagaaattcaagaggtgatagacatcacaccggaggaattaacagaagatgacttgatggagatgagtacttccaaaccagcgccagacaatgaggaagattacataaaagaagcagtgccagaaaataaattgacatttgttccaaaggttccaattattcaagactgcctttggcttcttttacaacatggatgattctatgttatgggcactgaaactaaaagaaactgtggaaggattggtaccttagagaaatgaaaaagcaaaaacatcagaaattatggtgtatttctgtaaagttagtgacactgagtgtgcccacctctcttgcctcctctttaacctcccctacctgtttcatctctaccacccctgagacagcaagaccaacccctccacttcctcctctacttcagcctactcaacgtggagatgacaaagatgaagacctttatgatgatccacttccatttaatgaataatgctgagctttttataccaccaaagatcaacagaagaacccagtggaagctgagcctgctagactga

SEQ ID NO: 6331 - DNA, 599 bp, Artificial Sequence
  Synthetic polypeptide
gctggacacagtggcacacacctgtaaccccagatatttgggaggctgagtcaggaggattgcttgagcctaggagttcaggtgagtgtctgggtggtgctttatactggaaggaacttgctgtccttgctcaaaaaattgggttctgccctccacgtttggtcactgccaatctcattacaattcaaaacaaggaactggaaagagttatcggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggaaggtgaaattgttgaagtggatgaagaaacagcagctatcttgaagaattcaagatttgctcaagattttctgatcagaccaattggagagaagttgccaacatctggaggctgttctgctttggagttaaaggatataatcacagatccatttaagcttgcagaagagtctgacagtatgaagtccagatgtgtccctgatgctgctggaggctgctgtggcacaaagaaaagctgctaa

SEQ ID NO: 6332 - DNA, 672 bp, Artificial Sequence
  Synthetic polypeptide
ttctttgaggccagggtgtgcctgccttggggccttcctaatcgctctccctctcgtgggaatgtccttcctcagataacttgaatggccccttgcctccttcaggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggtga

SEQ ID NO: 6333 - DNA, 693 bp, Artificial Sequence
  Synthetic polypeptide
ttctttgaggccagggtgtgcctgccttggggccttcctaatcgctctccctctcgtgggaatgtccttcctcagataacttgaatggccccttgcctccttcaggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactga

SEQ ID NO: 6334 - DNA, 645 bp, Artificial Sequence
  Synthetic polypeptide
ttctttgaggccagggtgtgcctgccttggggccttcctaatcgctctccctctcgtgggaatgtccttcctcagataacttgaatggccccttgcctccttcaggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccat

SEQ ID NO: 6335 - DNA, 619 bp, Artificial Sequence
  Synthetic polypeptide
ttctttgaggccagggtgtgcctgccttggggccttcctaatcgctctccctctcgtgggaatgtccttcctcagataacttgaatggccccttgcctccttcaggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttga

SEQ ID NO: 6336 - DNA, 522 bp, Artificial Sequence
  Synthetic polypeptide
ttctttgaggccagggtgtgcctgccttggggccttcctaatcgctctccctctcgtgggaatgtccttcctcagataacttgaatggccccttgcctccttcaggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaag

SEQ ID NO: 6337 - DNA, 300 bp, Artificial Sequence
  Synthetic polypeptide
ttctttgaggccagggtgtgcctgccttggggccttcctaatcgctctccctctcgtgggaatgtccttcctcagataacttgaatggccccttgcctccttcaggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgag

SEQ ID NO: 6338 - DNA, 276 bp, Artificial Sequence
  Synthetic polypeptide
ttctttgaggccagggtgtgcctgccttggggccttcctaatcgctctccctctcgtgggaatgtccttcctcagataacttgaatggccccttgcctccttcaggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccg

SEQ ID NO: 6339 - DNA, 237 bp, Artificial Sequence
  Synthetic polypeptide
ttctttgaggccagggtgtgcctgccttggggccttcctaatcgctctccctctcgtgggaatgtccttcctcagataacttgaatggccccttgcctccttcaggaaggagatgacaaaattgagtaccgagcctggaaccccttccgctccaagctagcagcagcaatcctgggtggtgtggaccagatccacatcaaaccgggggctaaggttctctacctcggggctgcctcg

SEQ ID NO: 6340 - DNA, 116 bp, Artificial Sequence
  Synthetic polypeptide
ttctttgaggccagggtgtgcctgccttggggccttcctaatcgctctccctctcgtgggaatgtccttcctcagataacttgaatggccccttgcctccttcaggaaggagatga

SEQ ID NO: 6341 - DNA, 1250 bp, Artificial Sequence
  Synthetic polypeptide
gcgtggcatggggcacatcgcccggacttcctgtccctcttgggtttaggaatgggatggtgaggcctccctggcagcttgttaggaggagtaaaccaagcgagccgaccagctcccagcagggtcctggcacacaggaaaaggcccacaaagagaagcccaaccagccagcccccaggccgccccgccagggacccaccaatgaggcacagatggcagccgctgccgccctagcccggctggagcagaagcagtcccgggcctggggccccacatcgcaggacaccatccgaaaccaggtgagaaaggaacttcaagccgaagccaccgtcagcgggagccccgaggccccagggaccaacgtgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtga

SEQ ID NO: 6342 - DNA, 1379 bp, Artificial Sequence
  Synthetic polypeptide
gcgtggcatggggcacatcgcccggacttcctgtccctcttgggtttaggaatgggatggtgaggcctccctggcagcttgttaggaggagtaaaccaagcgagccgaccagctcccagcagggtcctggcacacaggaaaaggcccacaaagagaagcccaaccagccagcccccaggccgccccgccagggacccaccaatgaggcacagatggcagccgctgccgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtga

SEQ ID NO: 6343 - DNA, 514 bp, Artificial Sequence
  Synthetic polypeptide
gcgtggcatggggcacatcgcccggacttcctgtccctcttgggtttaggaatgggatggtgaggcctccctggcagcttgttaggaggagtaaaccaagcgagccgaccagctcccagcagggtcctggcacacaggaaaaggcccacaaagagaagcccaaccagccagcccccaggccgccccgccagggacccaccaatgaggcacagatggcagccgctgccgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagt

SEQ ID NO: 6344 - DNA, 576 bp, Artificial Sequence
  Synthetic polypeptide
gatcagagacagtttttgctaatctttggagaaataagataaaaaagtaaaaatgtcagtatagtttttcttaaatccaattttattcaagctaaaggcacacacaccatttcttctgagattatgtttaagtgctgtggagtagtatatttcactgactggttggaaatgacagagatggactggcccccagattcctgctgtgttagagaattcccaggatgttccaaacaggcccaccaggaagatctcagtgacctttatcaagagggttgtgggaagaaaatgtattcctttttgagaggaaccaaacaactgcaggtgctgaggtttctgggaatctccattggggtgacacaaatcctggccatgattctcaccattactctgctctgggctctgtattatgatagaagggagccggggacagaccaaatgatgtccttgaagaatgacaactctcagcacctgtcatgtccctcagtagaactgttgaaaccaagcctgtcaagaatctttgaacacacatccatggcaaacagctttaatacacactttgagatggaggagttataa

SEQ ID NO: 6345 - DNA, 1883 bp, Artificial Sequence
  Synthetic polypeptide
caccgtctccctctgatgccgagccgaggctggactgtactgccaccatcttgactcactgcaacctccctgcctgattctcctgcctcagtctgccgagttcctgggattgcaggtgcgcgccgccactcctgactggtttttgtattttttggtggagacggggtttcaccgtgttggccgggctggtctccagctcctgaccgcgagtgatctgccagcctcggcgtcctgaggtgccgggattgcagacggagtctcgctcactcagtgctcaatgttgcccatgctggagtgcagtggcgtgatcttggctcgctacaacctccacctcccagccgcctgccttggcctcccaaagtgccgagattgcagcctctgcccggccgccaccccgtctaggaagtgaggagcgtctttgcctggccgcccatcgtcggggatgtgaggagcccctctgcccggccgcccagtctgggaagtgaggagcacctcttcccggccgtcatcctgtctaggaagtgaggagcgtctctgcccagccgcccatcatctgggatgtggggagcatctctgccccgtcgccccgtctgagatgtgaagagcgcctctgcccggccgcgaccctgtctgggaactgaggagtgtctctgccccgccgccaccccgtctgggaggtgaggagcgtctctgaccggctgcccggtctgagaagtgaggagcccctccgcccggcagccgccccgtctgggaagtgaggagcgtttccgctttccgcccggcagcggccccgtccgggaggtggggggcagcccccgcccggccggcgccccgtctgggaggtggagggcgcctctgcccggccgccccatctgggaagtgaggagcccctctgcccggccgccaccccgtctgggaggattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataa

SEQ ID NO: 6346 - DNA, 508 bp, Artificial Sequence
  Synthetic polypeptide
ggcttggcacggtggcacacgcctgtaatcccagcactttgggaggccaaggttggcggatcacctgaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctga

SEQ ID NO: 6347 - DNA, 305 bp, Artificial Sequence
  Synthetic polypeptide
ggcttggcacggtggcacacgcctgtaatcccagcactttgggaggccaaggttggcggatcacctgaggtatcaaggttacattggtgcagccctagttttagggggagtagatgttactggacctcacctctacagcatctatcctcatggatcaactgataagttgccttatgtcaccatggtccattgtgaagaggagctctttacagagaatcttttctttattaggcaagctgaagtagtgtcagaagaagcttggggaccatcttttgctattagcttggcagtgttccttgtagcag

SEQ ID NO: 6348 - DNA, 709 bp, Artificial Sequence
  Synthetic polypeptide
tttctttacagtttctccctgggtgatctcatccgttctgtgaccttaaatcctttctagatattgataaactcttaaatttacatccttagctcagacctctcctctgagccctgatttacagatctaacttcttgctttacatcacttcttggaaatctaacatatttaaaacagcttttgccttttttcctcctgatgaaacctgtccttcctcgagtctttcctacctcagtaatgagcaccacccggctgctcgaacctgaaaccgtagagcaccattccttcctctttcttcccaacctgacatccagtccatcggcacctcctgccagttgtgcccccaagattcgcctccagcatgtcctgttggctccatccctacagtcggcacgaggggctggccagccactgggcgcctggagctgtgctaacctgcttctgctctggagtttaacagccaggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatccattgatgtgggcaagacctcctga

SEQ ID NO: 6349 - DNA, 588 bp, Artificial Sequence
  Synthetic polypeptide
tgaaatggtttggatatgtgtcacctccaaatatcatgttgaaatgtgacctccagtgttggaggtgagcctagtgggaagtgtttgggtcatgggggtggatccctcatgaatggtgtggtgctgtccttgtgataatgaaagagttcttgctctgacttcatgtgagatctggttgtttaaaagagcgtggcacctcctcttgctctcactgccactctcatcttgtgatgtgcctgctctcccttcacctcctgccatgattgtaagcttgctgaggtctttgccagaagcagatgctggcaccatgcttcctgtacagcctgcagaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagaga

SEQ ID NO: 6350 - DNA, 1376 bp, Artificial Sequence
  Synthetic polypeptide
tgaaatggtttggatatgtgtcacctccaaatatcatgttgaaatgtgacctccagtgttggaggtgagcctagtgggaagtgtttgggtcatgggggtggatccctcatgaatggtgtggtgctgtccttgtgataatgaaagagttcttgctctgacttcatgtgagatctggttgtttaaaagagcgtggcacctcctcttgctctcactgccactctcatcttgtgatgtgcctgctctcccttcacctcctgccatgattgtaagcttgctgaggtctttgccagaagcagatgctggcaccatgcttcctgtacagcctgcagaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagggatgccaagggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaa

SEQ ID NO: 6351 - DNA, 1280 bp, Artificial Sequence
  Synthetic polypeptide
tgaaatggtttggatatgtgtcacctccaaatatcatgttgaaatgtgacctccagtgttggaggtgagcctagtgggaagtgtttgggtcatgggggtggatccctcatgaatggtgtggtgctgtccttgtgataatgaaagagttcttgctctgacttcatgtgagatctggttgtttaaaagagcgtggcacctcctcttgctctcactgccactctcatcttgtgatgtgcctgctctcccttcacctcctgccatgattgtaagcttgctgaggtctttgccagaagcagatgctggcaccatgcttcctgtacagcctgcagaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctag

SEQ ID NO: 6352 - DNA, 1259 bp, Artificial Sequence
  Synthetic polypeptide
tgaaatggtttggatatgtgtcacctccaaatatcatgttgaaatgtgacctccagtgttggaggtgagcctagtgggaagtgtttgggtcatgggggtggatccctcatgaatggtgtggtgctgtccttgtgataatgaaagagttcttgctctgacttcatgtgagatctggttgtttaaaagagcgtggcacctcctcttgctctcactgccactctcatcttgtgatgtgcctgctctcccttcacctcctgccatgattgtaagcttgctgaggtctttgccagaagcagatgctggcaccatgcttcctgtacagcctgcagaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaaagagagagcaacagagatggggaggaatccagctctgcctga

SEQ ID NO: 6353 - DNA, 981 bp, Artificial Sequence
  Synthetic polypeptide
tgaaatggtttggatatgtgtcacctccaaatatcatgttgaaatgtgacctccagtgttggaggtgagcctagtgggaagtgtttgggtcatgggggtggatccctcatgaatggtgtggtgctgtccttgtgataatgaaagagttcttgctctgacttcatgtgagatctggttgtttaaaagagcgtggcacctcctcttgctctcactgccactctcatcttgtgatgtgcctgctctcccttcacctcctgccatgattgtaagcttgctgaggtctttgccagaagcagatgctggcaccatgcttcctgtacagcctgcagaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcagttaagcctgagcccttgccacacggatttccttctcacccgcttcctccccgcaccactctggggatcagaagtatcagtgccaagtggtccctttcatctcctcataattcttccccagccacttagtgggttagtcaggccctgccttctcttcagccagccctgcagtc

SEQ ID NO: 6354 - DNA, 691 bp, Artificial Sequence
  Synthetic polypeptide
tgaaatggtttggatatgtgtcacctccaaatatcatgttgaaatgtgacctccagtgttggaggtgagcctagtgggaagtgtttgggtcatgggggtggatccctcatgaatggtgtggtgctgtccttgtgataatgaaagagttcttgctctgacttcatgtgagatctggttgtttaaaagagcgtggcacctcctcttgctctcactgccactctcatcttgtgatgtgcctgctctcccttcacctcctgccatgattgtaagcttgctgaggtctttgccagaagcagatgctggcaccatgcttcctgtacagcctgcagaactgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactgggtaaggatttttgagaatggaaaaaaagatgacttcatccataataaaataatcaattcatatgtcca

SEQ ID NO: 6355 - DNA, 1002 bp, Artificial Sequence
  Synthetic polypeptide
aatagccaaaagatggaagcaacccagatatccactgacaggtgagtgaataaacaaaatgtggtatatagctataatggaatgttattcatccttgagaaggaagaaaattctgatgcatgatacaacagagataaacatcaaggacattatgctaaatgaaataagccagtcacaaaaatacaaatagtgtgtgattccacttacataaggtacctggagtcatcaagtccatagaaacagaaagtacactggcggctgccaggggctgaagagaagggaacaaactggttggctgagattctctgcctgatgcactccaagggggatgccaagtggatccaatctgtgcccatctgggagcgatcaccctgggtagagagtgagattgggtatacagcactcagtgaaacggagagtccacgtttattctcctcccacctccccatccagttattccccaagtctttcttcagttccaaggccaaggtgatttatctcatgagaaatcccagagatgttttggtgtctggttattttttctggaaaaacatgaagtttattaagaaaccaaagtcatgggaagaatattttgaatggttttgtcaaggaactgtgctatatgggtcatggtttgaccacattcatggctggatgcccatgagagaggagaaaaacttcctgttactgagttatgaggagctgaaacaggacacaggaagaaccatagagaagatctgtcaattcctgggaaagacgttagaacccgaagaactgaacttaattctcaagaacagctcctttcagagcatgaaagaaaacaagatgtccaattattccctcctgagtgttgattatgtagtggacaaagcacaacttctgagaaaaggtgtatctggggactggaaaaatcacttcacagtggcccaagctgaagactttgataaattgttccaagagaagatggcagatcttcctcgagagctgttcccatgggaataa

SEQ ID NO: 6356 - DNA, 325 bp, Artificial Sequence
  Synthetic polypeptide
aaaataaaattataaaccctcaaccatctgaacggacccctcctgtcgggcaaaggcattgcaaagttatcctaaaaaactagttcaggtcacgaagggaaggagaagtttggacatgcctcattattccctcctcccttttggaattcagacactgctgaccagcattaccattaaaacagatcttaagactgatagaacagactctttaaatctggatataatcacagatccatttaagcttgcagaagagtctgacagtatgaagtccagatgtgtccctgatgctgctggaggctgctgtggcacaaagaaaagctgctaa

SEQ ID NO: 6357 - DNA, 742 bp, Artificial Sequence
  Synthetic polypeptide
ggatttggggaccaggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacaggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaa

SEQ ID NO: 6358 - DNA, 590 bp, Artificial Sequence
  Synthetic polypeptide
ggatttggggaccaggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacaggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaagaccctacgtccgctccaagggccggaagttcgagcgtgccagaggccgacgggccagccgaggctacaaaaactaaccctggatcctactctcttattaaaaagatttttgctgacag

SEQ ID NO: 6359 - DNA, 577 bp, Artificial Sequence
  Synthetic polypeptide
ggatttggggaccaggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacaggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggccccaggaaccccgcacagccacaccaaaccctacgtccgctccaagggccggaagttcgagcgtgccagaggccgacgggccagccgaggctacaaaaactaa

SEQ ID NO: 6360 - DNA, 430 bp, Artificial Sequence
  Synthetic polypeptide
ggatttggggaccaggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacaggagtggacatccgccataacaaggaccgaaaggttcggcgcaaggagcccaagagccaggatatctacctgaggctgttggtcaaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactga

SEQ ID NO: 6361 - DNA, 670 bp, Artificial Sequence
  Synthetic polypeptide
ggatttggggaccaggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacaggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaagtga

SEQ ID NO: 6362 - DNA, 892 bp, Artificial Sequence
  Synthetic polypeptide
ttagagccctagacttctttgtttgaaagatacctgctggactagcagtctttcttcctgtctctctctgtctggagggaggattgatccctgacttcctgggttggtagtttttcttcctggctctcagtcttgagtgggaaatttttcttggctctttgtgaggcctctccattctctctattttatcctgtttctctcatggaaaattctcagttggctgaaactcccttcttgaactcctactgactatatgctctaccaatctgtccacctccttcctgttggcataaatttgcagagaataatttggaacttcattgtcctctttgggaaacttatgatctccccaaactggcttctgtaaggcctctcccttcccattcctcctttgttctttaaccacttttgatcttcccttcagcgaccttgaagcctttgatatatcccccttttaactctaccaccttcatccctctgttcattctgccaggcttttcatttcccacttcaacctctcagctcccaacagtcacttgaactatagaccccttggcctccattgggggctctccttaagagactgagggatccctgagggatccccaaaagcaatgattagaggctgaaaacagaaaaaaaactttggaaacagactggatgttttgtacactcagagaatccgacaacagctgctccagctgacacgtatccagctactggtcctgctgatgatgaagcccctgatgctgaaaccactgctgctgcaaccactgcaaccactgctgctcctaccactgcaaccaccgctgcttctaccactgctcgtaaagacattccagttttacccaaatgggttggggatctcccgaatggtagagtgtgtccctga

SEQ ID NO: 6363 - DNA, 348 bp, Artificial Sequence
  Synthetic polypeptide
cctggatttgaagaccagccctgctacttaccagccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttga

SEQ ID NO: 6364 - DNA, 80 bp, Artificial Sequence
  Synthetic polypeptide
gctgggtgtggtggcgcgtgcctgtaatcctaccgctttgggaggctgaggccaagaagacgctggagggaggctgttag

SEQ ID NO: 6365 - DNA, 217 bp, Artificial Sequence
  Synthetic polypeptide
gctgggtgtggtggcgcgtgcctgtaatcctaccgctttgggaggctgaggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttag

SEQ ID NO: 6366 - DNA, 2319 bp, Artificial Sequence
  Synthetic polypeptide
cctcatttgactgtactttacatatatttcattttttacaaattgaaggtttatggcaatcttgctttgagcaagcttattggcaccattttttccaacagcatgtgctcactttgtgtttctgtgtcacgctttggtaattctcccaacatttcaaacgttttattattatatctgttatggtatctgtgatcagtgatctttgatattactaccgtaattgttttgggatgccacaaactatacccatatatgctggcaaacttaattgatttcatgtatgtgttctgactgctccattaaccagccatttccccatctcttttcctctctttgaacttctctattccctgagacacaataatattgaaatgaggccagataataaccctacaaaggcctgtaagcattcaagtcacacgtctctcactttaagtcaaaaactagaaatgattaagcttagtgaggaaggcatattgaaagccaggatggtctgatagctaggcctcttgtgcaaaacaataagccaagttgtgaatgcaaaggaaaagttcttgaaggaaattaaaagtgctgctccagtgaacacatgaatgacgagaaagcaaaacagtattattgctgatatggagaaagtttgagtggtctggatagaagatcaaactagctacaacattttcttaagcctaatctggagcaaggccatacctcttttcagttctgttaaggctgagagaggtgaggaagctacagaagaaaggtctgaagctagcagttggttcatgaggtttaaggaaagaagtcatctccataacataaaagtgcatggtgaagcagcatatgctgatggagaagctgcaagttatccagaagatcaagctcagatcttccgtgaaggtggctacgtaaacaacagattttccatgtagatgactagccttctcttgggaagaagatgccatctaggacttctgtagctagagaggagatgtcaacacctgccttcaaagcttcaaaggacaggctgattgtcttgttaatgcagacggtgactttcagttgaagccaatgatcatttgatattcagaaaattttagggtccttaagaatgatgctaaatcttctctgcctatgttctataaatggaacaacagagccgggatgatagtatatctatttatagcctggattactgaatctcttaagccctctgttgagacgtactgctcagaaaaagattcctttgaaaatattactgctaattgacaatgcaccttgtaatccaagaagtccgatatagatatatttacaaagagattaatattttcatttctgctaacacagcatccattctgcagcccatggatcaaggaatcatttagactttcatttcttgttatttaagaaatacagtttgtgagactatagctgccacagtgattgctttgatggatctgagaatagtaaattggaaacttcctggaaaggattcaccattttagatgcccttaagaacattcatgatttatgggaagagctcaaagtatcaacattaacatgagtttggaataagttggttccaatcctcatggatgactttgaggggtttaagacttcattggaggaagtaactgcagatatcatgaaaatagcaagaaaactagaattagaaggggagcctgaagatgtgactgaactgctgcaatctcatgataaaacttgaacaagtaaggagttgcttcttaaagatgagcaaataaactgatttcttgagatggaatctactcctaataaagaggtcatgaacagtgttaaaatgaccacaaaccataaaggatttagaagattacataaatgtagttgataaagcagcagcagaatttgagaggattgacaacatttttggaagaagttctcctgtgggtaaagtgctgtcaaacagcatcacatgctacagagaaatctttcataaaagaaagagtcaaatgtggcaaacttcattattgtcttattttaggaaatttccacagccaccccaatcttcagcaaccgccgtcctgatcagtcaggagatatcaacatcaaagcaagcccctccatcagcaaaaagatggcaacttgctgaaggctgagatgatcattagcatttttaggaataaagtgttttttaattaagatgggcggaagccatttccaattaaccatggtgaaactagtgatgaaactttattagaggatgccatagaagtttgcaagaagtttatggagcgcgaccctgatgaactaagatttaatgcgattgctctttctgcagcatag

SEQ ID NO: 6367 - DNA, 348 bp, Artificial Sequence
  Synthetic polypeptide
tgtggttcccaaaccaggctgtacatcagagtaacctaggaaacgtcaacaaacacagtgaatggcctccaagctcggacctttgggatctggacgctgctctcatcagtgattcgctgcctctgtgccattgacattcacaacaagacgctctatcacatcacactctggaccttcctccttgccctggggcatttcctctctgagttgtttgtctatggaactgcagctcccacgattggcgtcctggcacccctgatggtggcaagtttctccatcctgggtatgctggtcgggctccggtatctagaagtagaaccagtatccagacagaagaagagaaactga

SEQ ID NO: 6368 - DNA, 1050 bp, Artificial Sequence
  Synthetic polypeptide
ggccgggcgcggtggctcacacctgtaatcctagcactttgggaggctgaggcgggcggatcacgagatcaggagatcgagaccatcctggctaacatgcctcagaagtcccgggctgaagacctgggcctgaaggcgaaggccctggagaagacagttgcatcatggcagcacatggccactgaggctgcccgaaccctccagactgctgcccaggcgacgctacggcaaacagaacccctcacaaagctgcaccaggaggccagagccgccctgacccaggcttcctcatctgtccaggctgcgacagtgactgtcatgggagccaggactctgctggctgatctggaaggaatgaagctgcagtttccccggcccaaggaccaggcggcattgcagaggaaggcagactccgtcagtgacagactccttgcagacacgagaaagaagaccaagcaggcggagaggatgctgggaaacgcggcccctctttcctccagtgccaagaagaagggcagagaagcagaggtgttggccaaggacagtgccaagcttgccaaggccttgctgagggagcggaaacaggcgcaccgccgtgccagcaggctcaccagccagacgcaagccacgctccaacaggcgtcccagcaggtgctggcgtctgaagcacgcagacaggagctggaggaagctgagcgggtgggtgctgggctgagcgagatggagcagcagatccgggaatcgcgtatctcactggagaaggacatcgagaccttgtcagagctgcttgccaggctggggtcgctggacacccatcaagccccagcccaggccctgaacgagactcagtgggcactagaacgcctgaggctgcagctgggctccccggggtccttgcagaggaaactcagtctgctggagcaggaatcccagcagcaggagctgcagatccagggcttcgagagtgacctcgccgagatccgcgccgacaaacagaacctggaggccattctgcacagcctgcccgagaactgtgccagctggcagtga

SEQ ID NO: 6369 - DNA, 450 bp, Artificial Sequence
  Synthetic polypeptide
gttgaaagcccctgcgttgaagtaatctgccgggacttgaaacttggctttggcactgattgtctgacgtgcctaacttgctcagaagataaaataacagtccactttataaaccgtgatggtgaaacattaacaaccaaaggaaaagttggtgattctctgctagatgttgtggttgaaaataatctagatattgatggctttggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatccattgatgtgggcaagacctcctga

SEQ ID NO: 6370 - DNA, 338 bp, Artificial Sequence
  Synthetic polypeptide
ggccgggcgcggtggctcatgcctgtgatcccagccctttgggaggccgaggtgaatgtaaaagctttaaagagaaattcatgaagtgtcttcataacaataattttgaaaatgctttgtgcagaaaggaatcaaaagaatatttagaatgcaggatggagagatcccgactgggcctcctacactctgggcgtcttcatctgcctgagctgctcgggaatccaccggaatatcccccaggtcagcaaggtgaagtccgtccgcctggacgcctgggaggaggcccaagtggagttcatggcctcccacgggaacgacgccgcgagagccaggtttga

SEQ ID NO: 6371 - DNA, 242 bp, Artificial Sequence
  Synthetic polypeptide
ggccgggcgcggtggctcatgcctgtgatcccagccctttgggaggccgaggtgaatgtaaaagctttaaagagaaattcatgaagtgtcttcataacaataattttgaaaatgctttgtgcagaaaggaatcaaaagaatatttagaatgcaggatggagagaaaattgatgctacaagaaccattggagaaactgggatttggagacttgactagtggaaaatcagaggcaaaaaaatga

SEQ ID NO: 6372 - DNA, 506 bp, Artificial Sequence
  Synthetic polypeptide
tagatggaataatgcctccccaaaatatccaagtcctaatcactggaacctgtgaatatgttgacttgcatggcacaggggactttgcagatgtaatttagttaaggatcctaagattgaaaaattatactggactattcaggtggaacaatataatcacaaggattcttatcagagggaggcaggagggcccaagtcagagaagatgtgacaatggaagcagaagttagaatggtgcagtaaaagggccatgggccgaggaactcagacagcctgtagaagctggaaaaggaattttcaataaacgtgacttcactaggtggcctaagccccgatgtaaaatgtatatcccactggaccctgattacaatgcagactgccccaatgtgacagcacctgtttgtgcctcaaatggccacactttccagaatgagtgtttcttttgtgttgaacagagggaatttcattatcgtataaaatttgaaaaatatggaaaatgtgattaa

SEQ ID NO: 6373 - DNA, 605 bp, Artificial Sequence
  Synthetic polypeptide
gccagcatggtggggagttatatttcagtgacgtctatacgagccttgaactgccagaagaaatcaggacacacaaagttttatggggtgagtgtctgggtggtgctttatactggaaggaacttgctgtccttgctcaaaaaattgggttctgccctccacgtttggtcactgccaatctcattacaattcaaaacaaggaactggaaagagttatcggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggaaggtgaaattgttgaagtggatgaagaaacagcagctatcttgaagaattcaagatttgctcaagattttctgatcagaccaattggagagaagttgccaacatctggaggctgttctgctttggagttaaaggatataatcacagatccatttaagcttgcagaagagtctgacagtatgaagtccagatgtgtccctgatgctgctggaggctgctgtggcacaaagaaaagctgctaa

SEQ ID NO: 6374 - DNA, 665 bp, Artificial Sequence
  Synthetic polypeptide
taattattcagttaccttctgtcttccttggtagatgtactcgggagaggagacgttttctgtcttgtgaactgtcgtttgccaagcacccggcctggcacagcgttcaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctga

SEQ ID NO: 6375 - DNA, 518 bp, Artificial Sequence
  Synthetic polypeptide
taattattcagttaccttctgtcttccttggtagatgtactcgggagaggagacgttttctgtcttgtgaactgtcgtttgccaagcacccggcctggcacagcgttcaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctggacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctga

SEQ ID NO: 6376 - DNA, 243 bp, Artificial Sequence
  Synthetic polypeptide
ggctgggcgcggtggctcacgcctgtaatcccagcactttgggaggccgaggtgggtggatcacgaggtcaggagatcgagaccatcctggctaacacagtgaaaccccatctctattgaaaaagtacaaaaaaaattagccgggcgtggtggcgggtgcctgtagtcccagctacgtgggaggctgaagcaggagaatggcatgaacccaggaggcggagcttgcgggtgtggccactgtaa

SEQ ID NO: 6377 - DNA, 877 bp, Artificial Sequence
  Synthetic polypeptide
ggctgggcgcggtggctcacgcctgtaatcccagcactttgggaggccgaggtgggtggatcacgaggtcaggagatcgagaccatcctggctaacacagtgaaaccccatctctattgaaaaagtacaaaaaaaattagccgggcgtggtggcgggtgcctgtagtcccagctacgtgggaggctgaagcaggagaatggcatgaacccaggaggcggagcttgcgggtgtggccactgtaagaaaatgaagccggagtttgagaaggcagcagaagccctccatggagaagcggatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataa

SEQ ID NO: 6378 - DNA, 238 bp, Artificial Sequence
  Synthetic polypeptide
ggccaagcgcggtggctcatgcttctcatcctagcactttgggaggccgaggcgggtggatcacctgagatcaggagttcaagaccagcctggccaagttggtgaaaccccgtctctactaaaaatagaaaaataaggcaggttctgtttggattctgcaaagcagactcgtcagaaagttgctgtgaactggaccaacttcagcctcaagaaaaccactcctagcacagctcagtga

SEQ ID NO: 6379 - DNA, 497 bp, Artificial Sequence
  Synthetic polypeptide
ggccaggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttga

SEQ ID NO: 6380 - DNA, 2878 bp, Artificial Sequence
  Synthetic polypeptide
tggacagaacagcttgggagctgggcaccccagggtttagagcccacaacgcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccgggaagcgagggcgtcgcagcagtgcgggatcgctagagagcaatgtggaatttcagcctttcgagccactgcagccgtcagtgctgtgctcctaa

SEQ ID NO: 6381 - DNA, 2797 bp, Artificial Sequence
  Synthetic polypeptide
tggacagaacagcttgggagctgggcaccccagggtttagagcccacaacgcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccggggtccatcattag

SEQ ID NO: 6382 - DNA, 3508 bp, Artificial Sequence
  Synthetic polypeptide
tggacagaacagcttgggagctgggcaccccagggtttagagcccacaacgcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccgggaagcgagggcgtcgcagcagtgcgggatcgctagagagcaatgtggaagggtccatcattagcagtcctcacatgcgccggagagctacatcaacacgagagtgtccatctcgcccacaccagactatgcccaactcatcttccctcctgggctccttattcgggagcaagagagggaagccccctccccaggcccacctgccctcagccccagccctggccacccccccacccaccggtggtcctgcctcacttgcagcactctgtggctggccaccacctggggcccccagaggggctgccgcaggccgccatgcacgggcatcacacccagtactgccacatgcagaaccctcccccgtaccaccatcaccaccaccaccacccaccccagcacatccagcacgcacaccagtaccaccacggcccccatgggggccacccagcctacggggcccatgcccacggccacccgccgctgccctcggcccacgtggggcacacagtgcaccaccatgggcagccccctgccccgccgccccccaccagcagcaaggccaaacccagcggcatcagcacaattgtgtagacagcctgggtaggggtcccaggctccctgaaacacctgcacaccacacagggcacgcccgggggtcgccagccgcacaccaaacccggggcacttctgttgccatctctcccctctgcccctcacggcccaac

SEQ ID NO: 6383 - DNA, 467 bp, Artificial Sequence
  Synthetic polypeptide
gctggacacagtggcacacacctgtaaccccagatatttgggaggctgagtcaggaggattgcttgagcctaggagttcaggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggaaggtgaaattgttgaagtggatgaagaaacagcagctatcttgaagaattcaagatttgctcaagattttctgatcagaccaattggagagaagttgccaacatctggaggctgttctgctttggagttaaaggatataatcacagatccatttaagcttgcagaagagtctgacagtatgaagtccagatgtgtccctgatgctgctggaggctgctgtggcacaaagaaaagctgctaa

SEQ ID NO: 6384 - DNA, 201 bp, Artificial Sequence
  Synthetic polypeptide
acaaaacaagaagtaggcgaggctgtggagtgacagctgtctcctgtgatgcagatggaggcatgcattgggtcacaagttgacatcaacttgtggagttgaacctgcatgtgccttaggatccagcagccctactacttgggtgcataccttagaggtgacccacggacatgcacaagctcatctacatgcactggatga

SEQ ID NO: 6385 - DNA, 1469 bp, Artificial Sequence
  Synthetic polypeptide
acaaaacaagaagtaggcgaggctgtggagtgacagctgtctcctgtgatgcagatggaggcatgcattgggtcacaagttgacatcaacttgtggagttgaacctgcatgtgccttaggatccagcagccctactacttgggtgcataccttagaggtgacccacggacatgcacaagctcatctacatgcactggatgaacacggtggtgaattactgcggccccttcgagtatgaagtcggctactgcgagaggctgaagagcttcctggaggccaacctagagtggatgcaggaagagatggagtcaaacccagactcaccttactggcaccaggtgcggctgaccctcctgcagctgaaaggcctggaggacagctacgaaggccgtgtgagcttcccagctgggaagttcaccatcaaacccttggggttcctcctgctgcagctctctggggacctggaagacctggagctggccctgaacaagaccaagatcaaaccttctctgggctctggctcctgttctgccctcatcaagctgctccctggccagagtgacctcctggttgcccacaacacctggaacaactaccagcacatgctgcgtgtcatcaagaagtactggctccagttccgggaaggcccctggggggactacccgctggttcccggcaacaagctggtcttctcctcctaccccggcaccatcttctcctgcgacgacttctacatcctgggcagtgggctggtgacactggagaccaccattggcaacaagaacccagccctgtggaagtatgtgcggcccaggggctgtgtgctggagtgggtacgcaacatcgtggccaaccgcctggcctcggatggggccacctgggcagacatcttcaagaggttcaacagcggcaccggcatggtggtggtggctgacaagacctcggagctctaccagaagacctactgggccagctacaacataccgtccttcgagactgtgttcaatgccagtgggctgcaggccctagtggcccagtatggggactggttttcttatgacgggagcccccgggcccagatcttccggcggaaccagtcactggtacaagacatggactccatggtcaggctgatgaggtacaatgacttcctccatgaccctctgtcactgtgcaaagcctgcaacccccagcccaatggggagaatgctatctccgcccgctccgacctcaacccggccaatggctcctaccccttccaggccctgcgtcagcgctcccatgggggtatcgatgtgaaggtgaccagcatgtcactggccaggatcctgagcctgctggcggccagcggtcccacgtgggaccaggtgcccccgttccagtggagcacctcgcccttcagcggcctgctgcacatgggccagccagacctctggaagttcgcgcctgtcaaggtttcatgggactga

SEQ ID NO: 6386 - DNA, 1565 bp, Artificial Sequence
  Synthetic polypeptide
acaaaacaagaagtaggcgaggctgtggagtgacagctgtctcctgtgatgcagatggaggcatgcattgggtcacaagttgacatcaacttgtggagttgaacctgcatgtgccttaggatccagcagccctactacttgggtgcataccttagaggtgacccacggacatgcacaagctcatctacatgcactggatgaacacggtggtgaattactgcggccccttcgagtatgaagtcggctactgcgagaggctgaagagcttcctggaggccaacctagagtggatgcaggaagagatggagtcaaacccagactcaccttactggcaccaggtgcggctgaccctcctgcagctgaaaggcctggaggacagctacgaaggccgtgtgagcttcccagctgggaagttcaccatcaaacccttggggttcctcctgctgcagctctctggggacctggaagacctggagctggccctgaacaagaccaagatcaaaccttctctgggctctggctcctgttctgccctcatcaagctgctccctggccagagtgacctcctggttgcccacaacacctggaacaactaccagcacatgctgcgtgtcatcaagaagtactggctccagttccgggaaggcccctggggggactacccgctggttcccggcaacaagctggtcttctcctcctaccccggcaccatcttctcctgcgacgacttctacatcctgggcagtgggctggtgacactggagaccaccattggcaacaagaacccagccctgtggaagtatgtgcggcccaggggctgtgtgctggagtgggtacgcaacatcgtggccaaccgcctggcctcggatggggccacctgggcagacatcttcaagaggttcaacagcggcacgtataacaaccagtggatgatcgtggactacaaggcgttcatcccgggtgggcccagccccgggagccgggtgcttaccatcctggagcagatccccggcatggtggtggtggctgacaagacctcggagctctaccagaagacctactgggccagctacaacataccgtccttcgagactgtgttcaatgccagtgggctgcaggccctagtggcccagtatggggactggttttcttatgacgggagcccccgggcccagatcttccggcggaaccagtcactggtacaagacatggactccatggtcaggctgatgaggtacaatgacttcctccatgaccctctgtcactgtgcaaagcctgcaacccccagcccaatggggagaatgctatctccgcccgctccgacctcaacccggccaatggctcctaccccttccaggccctgcgtcagcgctcccatgggggtatcgatgtgaaggtgaccagcatgtcactggccaggatcctgagcctgctggcggccagcggtcccacgtgggaccaggtgcccccgttccagtggagcacctcgcccttcagcggcctgctgcacatgggccagccagacctctggaagttcgcgcctgtcaaggtttcatgggactga

SEQ ID NO: 6387 - DNA, 555 bp, Artificial Sequence
  Synthetic polypeptide
gttgaaagcccctgcgttgaagtaatctgccgggacttgaaacttggctttggcactgattgtctgacgtgcctaacttggtcagtccttaggaacccagtttctccatttgcaagttggatataataacagtgtagacctcctatggttaattgaagaatcaatgagttaatacagcgatacagctcagaagataaaataacagtccactttataaaccgtgatggtgaaacattaacaaccaaaggaaaagttggtgattctctgctagatgttgtggttgaaaataatctagatattgatggctttggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatccattgatgtgggcaagacctcctga

SEQ ID NO: 6388 - DNA, 148 bp, Artificial Sequence
  Synthetic polypeptide
ggcagactgggggaagggagagacatggaaggcctgggagtctacgttttcatcctggcttcactgtgtgactggaacaacaaggtgtccctgccttcactgtgctccaacctgaaggtcccctggcagtgctgagggaccgagccca

SEQ ID NO: 6389 - DNA, 1100 bp, Artificial Sequence
  Synthetic polypeptide
ggcagactgggggaagggagagacatggaaggcctgggagtctacgttttcatcctggcttcactgtgtgactggaacaacaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtag

SEQ ID NO: 6390 - DNA, 464 bp, Artificial Sequence
  Synthetic polypeptide
ggcagactgggggaagggagagacatggaaggcctgggagtctacgttttcatcctggcttcactgtgtgactggaacaacaaggtgtccctgccttcactgtgctccaacctgaaggtcccctggcagtgctgagggaccgagcccagcagatctcagtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctga

SEQ ID NO: 6391 - DNA, 280 bp, Artificial Sequence
  Synthetic polypeptide
ggcagactgggggaagggagagacatggaaggcctgggagtctacgttttcatcctggcttcactgtgtgactggaacaacaaggtgtccctgccttcactgtgctccaacctgaaggtcccctggcagtgctgagggaccgagcccagcagatctcagtgctggggagccaaaggcatccaggccagggctcctgtggcagctgcccctggcacctgtgttccagcccacatcccacatgcggctcgggcttcggaacacggagtggccgggccggacg

SEQ ID NO: 6392 - DNA, 1290 bp, Artificial Sequence
  Synthetic polypeptide
ggccaggtgcagtggctcacgcctgtaatcccagcactttgggaggctgaagctggcggatcacctgaggcaactttttcctgtacctgtgaggagcagtacgtgggtactttctgtgaagaatacgatgcttgccagaggaaaccttgccaaaacaacgcgagctgtattgatgcaaatgaaaagcaagatgggagcaatttcacctgtgtttgccttcctggttatactggagagctttgccagtccaagattgattactgcatcctagacccatgcagaaatggagcaacatgcatttccagtctcagtggattcacctgccagtgtccagaaggatacttcggatctgcttgtgaagaaaaggtggacccctgcgcctcgtctccgtgccagaacaacggcacctgctatgtggacggggtacactttacctgcaactgcagcccgggcttcacagggccgacctgtgcccagcttattgacttctgtgccctcagcccctgtgctcatggcacgtgccgcagcgtgggcaccagctacaaatgcctctgtgatccaggttaccatggcctctactgtgaggaggaatataatgagtgcctctccgctccatgcctgaatgcagccacctgcagggacctcgttaatggctatgagtgtgtgtgcctggcagaatacaaaggaacacactgtgaattgtacaaggatccctgcgctaacgtcagctgtctgaacggagccacctgtgacagcgacggcctgaatggcacgtgcatctgtgcacccgggtttacaggtgaagagtgcgacattgacataaatgaatgtgacagtaacccctgccaccatggtgggagctgcctggaccagcccaatggttataactgccactgcccgcatggttgggtgggagcaaactgtgagatccacctccaatggaagtccgggcacatggcggagagcctcaccaacatgccacggcactccctctacatcatcattggagccctctgcgtggccttcatccttatgctgatcatcctgatcgtggggatttgccgcatcagccgcattgaataccagggttcttccaggccagcctatgaggagttctacaactgccgcagcatcgacagcgagttcagcaatgccattgcatccatccggcatgccaggtttggaaagaaatcccggcctgcaatgtatgatgtgagccccatcgcctatgaagattacagtcctgatgacaaacccttggtcacactgattaaaactaaagatttgtaa

SEQ ID NO: 6393 - DNA, 337 bp, Artificial Sequence
  Synthetic polypeptide
ggagttagaaggcatcgcctctaatccaggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatag

SEQ ID NO: 6394 - DNA, 414 bp, Artificial Sequence
  Synthetic polypeptide
ggcatggtggctcatgcctgtaatctcagcactctgagaggaggaggcggacggatcacttgaggccaggagttcgagaacagtctggccagcatggggtcccagctgccaaagcccagaatgctgagagaatcaggccatggggatgcccatctccaggagtacgctggcaatttccaaggcatacgtttccattatgatcgcaacccagggacagatgcagtggcgcagactagcctggaagagttcaatgtactggagatggaagtcatgagaagacagctgtatgcagtcaaccggcgtctgcgcgccctggaggaacagggcgccacctggcgccacagggagaccctgatcatcgccgtgctggtgtcggccagcattgccaacctgtggctgtggatgaaccagtga

SEQ ID NO: 6395 - DNA, 691 bp, Artificial Sequence
  Synthetic polypeptide
gctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggacctgctccgaatcggagtcactctggcgggacaccagaagaaaatcttggccagtgtccagcacatgaagtcccaggccaagccgggaaccccgggtgggacaggaggaccggccccgcagtactga

SEQ ID NO: 6396 - DNA, 847 bp, Artificial Sequence
  Synthetic polypeptide
gctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactga

SEQ ID NO: 6397 - DNA, 121 bp, Artificial Sequence
  Synthetic polypeptide
attcaccatgtgaccctgagcatgtctttgaactcctctgagctcctgtttcctctccagagaaaaggctgttgtggctgtgcccatggtgctcagtgccatgggcttcactgcggcggga

SEQ ID NO: 6398 - DNA, 136 bp, Artificial Sequence
  Synthetic polypeptide
attcaccatgtgaccctgagcatgtctttgaactcctctgagctcctgtttcctctccagagaaaaggctgttgtggctgtgcccatggtgctcagtgccatgggcttcactgcggcgggaatcgcctcgtcctcc

SEQ ID NO: 6399 - DNA, 310 bp, Artificial Sequence
  Synthetic polypeptide
attcaccatgtgaccctgagcatgtctttgaactcctctgagctcctgtttcctctccagagaaaaggctgttgtggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactag

SEQ ID NO: 6400 - DNA, 230 bp, Artificial Sequence
  Synthetic polypeptide
attcaccatgtgaccctgagcatgtctttgaactcctctgagctcctgtttcctctccagagaaaaggctgttgtggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaa

SEQ ID NO: 6401 - DNA, 235 bp, Artificial Sequence
  Synthetic polypeptide
attcaccatgtgaccctgagcatgtctttgaactcctctgagctcctgtttcctctccagagaaaaggctgttgtggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactggggtttctctga

SEQ ID NO: 6402 - DNA, 848 bp, Artificial Sequence
  Synthetic polypeptide
tagtgggtaagagtgtgggctctcgaggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatct

SEQ ID NO: 6403 - DNA, 2278 bp, Artificial Sequence
  Synthetic polypeptide
tagtgggtaagagtgtgggctctcgaggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatctgccagaaactcaagcagtccagctcgccctctccgcccgaggagcccccggccccaagttcaacctctgtggaaaaaatgtttggaggcaagatagtgactcggatctgctgtctctgctgcctcaacgtctcctcccgggaggaggccttcacggacctctctctcgccttccctcctcctgagcgctgtcgccgccgccgcctgggctctgtgatgcgccccacagaagacatcacagcccgggagttgcccccaccaaccagtgcacaggggccaggcagggtgggtcctcggaggcaaaggaaacactgcatcacagaggacaccccccccaccagcctgtacatcgaaggcctggactccaaggaagctggtgggcagagcagtcaggaggaaaggatagagagggaggaagaagggaaggaggagagaacggagaaggaagaagtgggggaggaggaggaaagcaccagaggggaaggagagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgcgagtcgtgtgcctccctgcaggatgccgagaaggtggtggagctgagccaagggccgtgctacctcatcctcacactgctgcgcttctctttcgacctgcgcaccatgcggcgccgcaagatcctggatgacgtctccatccccctgctgctccgcctgccactggctggtggccgtggccaggcctatgacctctgcagtgtggtggtgcactctggagtgtcttcggagagtggtcactactactgctatgcccgtgagggcgctgcccgccctgccgcttctctgggaactgccgataggccagagcccgagaaccagtggtacctgttcaatgacactcgggtgtccttctcttccttcgaatctgtcagcaacgtcacctccttcttccctaaggacacagcctatgtgctgttttaccggcagcggcccagggaggggcccgaggctgagttgggctcttctagagtccggacagagcccaccctgcacaaggacttgatggaagccatttccaaagacaacatcctttacctacaggagcaggagaaggaggcccggagcagggcggcctacatctctgcactccccacatctccgcactgggggaggggctttgatgaagacaaggatgaggatgaaggctctccagggggctgcaatcctgcaggtggcaatggtggtgacttccacagactggtcttctaa

SEQ ID NO: 6404 - DNA, 889 bp, Artificial Sequence
  Synthetic polypeptide
agagatgaagcacacagtctcggaaatctggctgtgcaggttcaaattccagttctcctacttatctcttggtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagagttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataa

SEQ ID NO: 6405 - DNA, 988 bp, Artificial Sequence
  Synthetic polypeptide
agagatgaagcacacagtctcggaaatctggctgtgcaggttcaaattccagttctcctacttatctcttggtgataatagagtgacatccttcagagacctcattcatgaccaagatgaagatgaggaggaagaggaaggccagaggagcaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataa

SEQ ID NO: 6406 - DNA, 982 bp, Artificial Sequence
  Synthetic polypeptide
agagatgaagcacacagtctcggaaatctggctgtgcaggttcaaattccagttctcctacttatctcttggtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataa

SEQ ID NO: 6407 - DNA, 988 bp, Artificial Sequence
  Synthetic polypeptide
agagatgaagcacacagtctcggaaatctggctgtgcaggttcaaattccagttctcctacttatctcttggtgataatagagtgacatccttcagagacctcattcatgaccaagatgaagatgaggaggaagaggaaggccagagagacaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataa

SEQ ID NO: 6408 - DNA, 694 bp, Artificial Sequence
  Synthetic polypeptide
agagatgaagcacacagtctcggaaatctggctgtgcaggttcaaattccagttctcctacttatctcttggtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcaggctgtcctgctttcctcccttcaagcccttgttcagttga

SEQ ID NO: 6409 - DNA, 187 bp, Artificial Sequence
  Synthetic polypeptide
agagatgaagcacacagtctcggaaatctggctgtgcaggttcaaattccagttctcctacttatctcttggtgataatagagtgacatccttcagagacctcattcatgaccaagatgaagatgaggaggaagaggaaggccagaggggccacagtgtgtgtcacatgaatggcaaggtgaggtga

SEQ ID NO: 6410 - DNA, 75 bp, Artificial Sequence
  Synthetic polypeptide
agagatgaagcacacagtctcggaaatctggctgtgcaggttcaaattccagttctcctacttatctcttggtga

SEQ ID NO: 6411 - DNA, 835 bp, Artificial Sequence
  Synthetic polypeptide
agagattctctgcagaggttggaatcacccccttgggtgctggtagcaatctgtgaaggtagctttttagatgtcacaatgattgggggtggggtgctggtgacattggatgggcaggtgcagaactgctaaacaatgctctgggcaatcccacaaagcgaccacctggcccatatctggcatgactttcatgtcccgccggacattcaaggaatccgactatgttttctatataaacatatagtatttttcacatctgaaaatatacactgaattttccaggactgtgtataaatagaggtaagattgtactttattttgctcagaactttaccaagagttattaataatctccaaaaaatcaaattatagcaaacactaatgatgtttgagtcactaagcaacacacctatatctgtctgcattgtgatatcacattcgtggttattctacaggtacaagaatctgagcctcccttgtcctttagtgcaatcaagcagagtatccacatactgaaatacacaacattttctgtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtga

SEQ ID NO: 6412 - DNA, 567 bp, Artificial Sequence
  Synthetic polypeptide
ggccaggtgtggtggctaactcctgtaatcccagcactttgggaggccaaggcaggcagatcacttgagcttgccaaggccttgctgagggagcggaaacaggcgcaccgccgtgccagcaggctcaccagccagacgcaagccacgctccaacaggcgtcccagcaggtgctggcgtctgaagcacgcagacaggagctggaggaagctgagcgggtgggtgctgggctgagcgagatggagcagcagatccgggaatcgcgtatctcactggagaaggacatcgagaccttgtcagagctgcttgccaggctggggtcgctggacacccatcaagccccagcccaggccctgaacgagactcagtgggcactagaacgcctgaggctgcagctgggctccccggggtccttgcagaggaaactcagtctgctggagcaggaatcccagcagcaggagctgcagatccagggcttcgagagtgacctcgccgagatccgcgccgacaaacagaacctggaggccattctgcacagcctgcccgagaactgtgccagctggcagtga

SEQ ID NO: 6413 - DNA, 294 bp, Artificial Sequence
  Synthetic polypeptide
ccatcaccaagcggtgagactatcacctatcgccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6414 - DNA, 462 bp, Artificial Sequence
  Synthetic polypeptide
ccatcaccaagcggtgagactatcacctatcgccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6415 - DNA, 522 bp, Artificial Sequence
  Synthetic polypeptide
ccatcaccaagcggtgagactatcacctatcgccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6416 - DNA, 414 bp, Artificial Sequence
  Synthetic polypeptide
ccatcaccaagcggtgagactatcacctatcgccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6417 - DNA, 405 bp, Artificial Sequence
  Synthetic polypeptide
ccatcaccaagcggtgagactatcacctatcgccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttga

SEQ ID NO: 6418 - DNA, 792 bp, Artificial Sequence
  Synthetic polypeptide
acctctctgggcctcggtacctcagcgttgagctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaa

SEQ ID NO: 6419 - DNA, 369 bp, Artificial Sequence
  Synthetic polypeptide
acctctctgggcctcggtacctcagcgttgagctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctga

SEQ ID NO: 6420 - DNA, 249 bp, Artificial Sequence
  Synthetic polypeptide
acctctctgggcctcggtacctcagcgttgagctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctgggtccggggatcccgagctgtcctgcagctgtaccctga

SEQ ID NO: 6421 - DNA, 369 bp, Artificial Sequence
  Synthetic polypeptide
acctctctgggcctcggtacctcagcgttgagctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcaggtccggggatcccgagctgtcctgcagctgtaccctgagaactcagagcagttggagctga

SEQ ID NO: 6422 - DNA, 843 bp, Artificial Sequence
  Synthetic polypeptide
acctctctgggcctcggtacctcagcgttgagctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagagggaaggtggagcatttgagagaaggggcatccgaggccaccagactcggaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaa

SEQ ID NO: 6423 - DNA, 1086 bp, Artificial Sequence
  Synthetic polypeptide
tgttataggaaatagaaataaagtatttgggtagacggggagaagagagtccctggcagaaaactttccttctaacataaagtagctcagaaatagctcccttctaacctcatgcagttcaaagaaatcacttctctaactaaacaagcagcctgaaagatcaggctgtaaatcacagataaacccctggagcacagaaggagggcggggagtctcctgggtaatcaccaaacttcacaatgggccccagtaaaaacagtgggccttaataagcacattcctttccctttaggacatcaagatagagaagctaaaagtggacttggggaggtgggggtggagacgtcgtgggggaggggtgttggggggatgcctgcagctgcaagaagatgtctgggaacagacacagaaactctccctctcagataagcaaaagaaggcatcacagactaagtctgcccatgtgatccaggaataaagtgagagctgataaaaaaaaaaactctgctctataaagatagcacacctggtcccaactaaatcgtcaggccctaggaggataagacatcccctcctcactggcaccacccccgccacctgccactaactccctcctcactagcccatttataaaaaccctgacatttttactaagcaactcactcgggacccatctcttcaagggagagctgttctttctttttgcctattcaactttgctccaaactcaagtctgtgtgtgtagtgtgtgttcgcgacctccgtctccttgactgttcgaccaagagccttggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattga

SEQ ID NO: 6424 - DNA, 520 bp, Artificial Sequence
  Synthetic polypeptide
gtacagtgattaatagcccaaattccagagttgaactgcctccatctggatccttactttactctgcatgtagtaggcaatcttaggtcaagaaagatttggaaacatgacgagggtctattaccgagaagctatgggtgcatttattgtcttcgatgtcaccaggccagccacatttgaagcagtggcaaagtggaaaaatgatttggactccaagttaagtctccctaatggcaaaccggtttcagtggttttgttggccaacaaatgtgaccaggggaaggatgtgctcatgaacaatggcctcaagatggaccagttctgcaaggagcacggtttcgtaggatggtttgaaacatcagcaaaggaaaatataaacattgatgaagcctccagatgcctggtgaaacacatacttgcaaatgagtgtgacctaatggagtctattgagccggacgtcgtgaagccccatctcacatcaaccaaggttgccagctgctctggctgtgccaaatcctag

SEQ ID NO: 6425 - DNA, 496 bp, Artificial Sequence
  Synthetic polypeptide
aaaatctgactttttcagcacagacatgacaaagtaaatgctcattgaagcatttcagattttgggtttttggagtagggatgctcaactgctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtga

SEQ ID NO: 6426 - DNA, 2157 bp, Artificial Sequence
  Synthetic polypeptide
aagggcaaactggcacagtggaaggagtcgggcagatccagggcggactcctggcgccgccgcccactctcagtgaccatggacccttcacgttctgagccagtttcttcgactgcaaactggggcccgtaatagcgcccgcctcccggttctgagtattctagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccaggcatggcagggcccaagggagagacgggccctcatggatataaaggcatggtgggcgctatcggtgccactgggccaccgggtgaggaaggtcctaggggaccgccaggccgagctggggagaagggtgacgagggcagcccaggtattcgtggaccccaggggatcacaggcccgaaaggagcaacgggccccccaggcatcaacggcaaggatgggaccccaggcacgcctggcatgaagggcagtgcaggacaggcgggacagcccggaagtccaggccaccagggcctagcgggtgtgccaggccagcctgggacaaaaggaggccctggagaccagggtgagccgggcccgcagggccttcctggattctctggtccccctgggaaagagggagagccagggcctcgaggagaaattggtccccagggcatcatgggacagaagggtgaccaaggcgagaggggtccagtggggcaaccaggccctcagggaaggcagggccctaagggggagcagggcccccccggaattccagggccccaaggcttgccaggcgtcaaaggagacaagggctccccagggaagaccgggccccgcggcaaagtgggtgacccaggggtggccggcctccccggagagaaaggcgagaagggcgagtccggcgagccggggcccaagggacagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggagggccgggatgccactgaccagcacatcgtggatgtggcgctgaagatgctgcaagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggaaaacgtggagagaagggtgatccaggagaagtgggacgggggcaccccgggatgcctgggcccccagggatcccaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggatccatcaaggggccttga

SEQ ID NO: 6427 - DNA, 799 bp, Artificial Sequence
  Synthetic polypeptide
aagggcaaactggcacagtggaaggagtcgggcagatccagggcggactcctggcgccgccgcccactctcagtgaccatggacccttcacgttctgagccagtttcttcgactgcaaactggggcccgtaatagcgcccgcctcccggttctgagtattctagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccag

SEQ ID NO: 6428 - DNA, 336 bp, Artificial Sequence
  Synthetic polypeptide
aagggcaaactggcacagtggaaggagtcgggcagatccagggcggactcctggcgccgccgcccactctcagtgaccatggacccttcacgttctgagccagtttcttcgactgcaaactggggcccgtaatagcgcccgcctcccggttctgagtattctagaggtccaccgggagagcggggccccccgggtcccccgggaccgccgggagtgcctggatccgacggcatcgacgggcctcctggacctgttggcctccctggtgagattggaatccgaggccccaagggggaccctggaccagatggaccatcggggcccccaggaccccct

SEQ ID NO: 6429 - DNA, 369 bp, Artificial Sequence
  Synthetic polypeptide
gcggtttcatttacccaattgttgcggtatggaagtacttgtgttcagccagcttaccaaaacctgaggcagaaagtggataattttgtgtcaacacatctggacaagcaggaatggaatcctacgatgaacaaaaaccagttgcgaaatggtctgaggcagagtgtggttcagtcagggatgttggaagctggagtagacaggattatttctcaggtggtggatccaaaacttaaccacatcttcaggccacaaatagaacgagcaattcatgagttcctggcggcccagaaaaaagcagctgtgccagcaccccctccagagcccgaaggccaggaccctccagctccatctcaggacacttcctaa

SEQ ID NO: 6430 - DNA, 201 bp, Artificial Sequence
  Synthetic polypeptide
gcggtttcatttacccaattgttgcggtatggaagtacttgtgttcagccagcttaccaaaacctgaggcagaaagtggataattttgtgtcaacacatctggacaagcaggaatggaatcctacgatgaacaaaaaccagttgcgaaatggtctgaggcagagtgtggttcaaatacgccagacaccttttgaaagctaa

SEQ ID NO: 6431 - DNA, 2274 bp, Artificial Sequence
  Synthetic polypeptide
agctgggggaccttgggcatgccatttcacctctctgtcctctcctgtaaaacgggcgtcatgatttttgccttgtaggggggaccatgagaataaaaatgttttgaaaatagcaaagacataactaagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctga

SEQ ID NO: 6432 - DNA, 1026 bp, Artificial Sequence
  Synthetic polypeptide
agctgggggaccttgggcatgccatttcacctctctgtcctctcctgtaaaacgggcgtcatgatttttgccttgtaggggggaccatgagaataaaaatgttttgaaaatagcaaagacataactaagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggtgggcacaggcaggaggggctgggctagggtaacccacctaggccaggcgtctgtcctagcatcctcccccaaaaggaatgtttcctatttacccacacatcctgaccctcccctctcccactatagtcagggcgtcttcccagttcttggttcacatcccttgtgctaa

SEQ ID NO: 6433 - DNA, 522 bp, Artificial Sequence
  Synthetic polypeptide
agctgggggaccttgggcatgccatttcacctctctgtcctctcctgtaaaacgggcgtcatgatttttgccttgtaggggggaccatgagaataaaaatgttttgaaaatagcaaagacataactaagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagtcacctcactgccctgtccctgtcctttcccctag

SEQ ID NO: 6434 - DNA, 947 bp, Artificial Sequence
  Synthetic polypeptide
gccgggtgcagtggctcacgcctgtaatcccagcactttaggaggccaaggcggatggatcacgaggtcaggaattcaagaccagcctgaccaagatggtgaaaccctgtctctactaaaactacaaaaattagccaggcgcagtggcaggcgcctataatcccagctactcgggaggctgaggcaggagaatcacttgaacccaggtggcagaggttgcagtgagccaagatcacgccgctgcattccagcctcggcaacagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaa

SEQ ID NO: 6435 - DNA, 881 bp, Artificial Sequence
  Synthetic polypeptide
gccgggtgcagtggctcacgcctgtaatcccagcactttaggaggccaaggcggatggatcacgaggtcaggaattcaagaccagcctgaccaagatggtgaaaccctgtctctactaaaactacaaaaattagccaggcgcagtggcaggcgcctataatcccagctactcgggaggctgaggcaggagaatcacttgaacccaggtggcagaggttgcagtgagccaagatcacgccgctgcattccagcctcggcaacagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtatttga

SEQ ID NO: 6436 - DNA, 457 bp, Artificial Sequence
  Synthetic polypeptide
gagtgatgctgaggcaggagtacctgccaattgatgaggcagagacctggggtcagggctgcttgcccaacctctgcttagctgtttgaccttggcctggttacactgtctgtctctgagcttctagtttctcatctgcaaaaacatgaggaatgggggtggttcgtgttggtcgtctcagagagtcctcctgagctggcatgctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctga

SEQ ID NO: 6437 - DNA, 850 bp, Artificial Sequence
  Synthetic polypeptide
ttagagccctagacttctttgtttgaaagatacctgctggactagcagtctttcttcctgtctctctctgtctggagggaggattgatccctgacttcctgggttggtagtttttcttcctggctctcagtcttgagtgggaaatttttcttggctctttgtgaggcctctccattctctctattttatcctgtttctctcatggaaaattctcagttggctgaaactcccttcttgaactcctactgactatatgctctaccaatctgtccacctccttcctgttggcataaatttgcagagaataatttggaacttcattgtcctctttgggaaacttatgatctccccaaactggcttctgtaaggcctctcccttcccattcctcctttgttctttaaccacttttgatcttcccttcagcgaccttgaagcctttgatatatcccccttttaactctaccaccttcatccctctgttcattctgccaggcttttcatttcccacttcaacctctcagctcccaacagtcacttgaactatagaccccttggcctccattgggggctctccttaagagactgagggatccctgagggatccccaaaagcaatgattagaggctgaaaacagaaaaaaaactttggaaacagactggatgttttgtacactcagctggtcctgctgatgatgaagcccctgatgctgaaaccactgctgctgcaaccactgcaaccactgctgctcctaccactgcaaccaccgctgcttctaccactgctcgtaaagacattccagttttacccaaatgggttggggatctcccgaatggtagagtgtgtccctga

SEQ ID NO: 6438 - DNA, 1025 bp, Artificial Sequence
  Synthetic polypeptide
gggttggagccccagccacgtcatcagctccctgggacccctgcgtgagacgtgagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctag

SEQ ID NO: 6439 - DNA, 857 bp, Artificial Sequence
  Synthetic polypeptide
gggttggagccccagccacgtcatcagctccctgggacccctgcgtgagacgtgagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaag

SEQ ID NO: 6440 - DNA, 581 bp, Artificial Sequence
  Synthetic polypeptide
gggttggagccccagccacgtcatcagctccctgggacccctgcgtgagacgtgagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctg

SEQ ID NO: 6441 - DNA, 317 bp, Artificial Sequence
  Synthetic polypeptide
gggttggagccccagccacgtcatcagctccctgggacccctgcgtgagacgtgagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcgga

SEQ ID NO: 6442 - DNA, 294 bp, Artificial Sequence; identical to SEQ ID NO: 6413
  Synthetic polypeptide

SEQ ID NO: 6443 - DNA, 462 bp, Artificial Sequence; identical to SEQ ID NO: 6414
  Synthetic polypeptide

SEQ ID NO: 6444 - DNA, 522 bp, Artificial Sequence; identical to SEQ ID NO: 6415
  Synthetic polypeptide

SEQ ID NO: 6445 - DNA, 414 bp, Artificial Sequence; identical to SEQ ID NO: 6416
  Synthetic polypeptide

SEQ ID NO: 6446 - DNA, 405 bp, Artificial Sequence; identical to SEQ ID NO: 6417
  Synthetic polypeptide

SEQ ID NO: 6447 - DNA, 80 bp, Artificial Sequence; identical to SEQ ID NO: 6364
  Synthetic polypeptide

SEQ ID NO: 6448 - DNA, 217 bp, Artificial Sequence; identical to SEQ ID NO: 6365
  Synthetic polypeptide

SEQ ID NO: 6449 - DNA, 250 bp, Artificial Sequence
  Synthetic polypeptide
gagcatggacatcgtatttatgagaaataggcatggaatcctagctctgccgtgtattggctggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6450 - DNA, 418 bp, Artificial Sequence
  Synthetic polypeptide
gagcatggacatcgtatttatgagaaataggcatggaatcctagctctgccgtgtattggctggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6451 - DNA, 478 bp, Artificial Sequence
  Synthetic polypeptide
gagcatggacatcgtatttatgagaaataggcatggaatcctagctctgccgtgtattggctggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6452 - DNA, 370 bp, Artificial Sequence
  Synthetic polypeptide
gagcatggacatcgtatttatgagaaataggcatggaatcctagctctgccgtgtattggctggaggggtgctgtcatcctggtctcttccattgcagcttataatccagtagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6453 - DNA, 361 bp, Artificial Sequence
  Synthetic polypeptide
gagcatggacatcgtatttatgagaaataggcatggaatcctagctctgccgtgtattggctggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttga

SEQ ID NO: 6454 - DNA, 2248 bp, Artificial Sequence
  Synthetic polypeptide
tttcttggttccctgaccaggaagcgaggtgattaacggatggttgaggcagctccttaggcgactttagcctgccctgtggaacatccctgcgggggactccaaccagccaaagcaacgcggatcctgagagtgctcctgggtaggcacttgccctgatgggacgccttgccagagcagtgtgtggcaggcccccgtggaggatcagcacagtggctgaacaccaggaaggaactggcatttggagtctggacatctaaaacttgaccacaggcggagcagcagcagccggagccaggactctgcggaggggcaggacgggcaggtcccagagcagttctcaggcctcctccacggctcctccccggtgtgcgaggtggggcaggaccctttccagctgctctgtaccgctggccagagccatccagacgggtccccccagcagggcgcctgccacaaggccagcatgcagctggaggagacgggtgtgcatgctcctggagcctcccagcccagtgccctggaccagagcaagagagtgggctacctcacaggcctgcccaccaccaacagccgctcgcaccctgaaactttgactcacacagcatctccgcaccctggtggtgctgaggaaggagaccggagtggggccaggagccgagcgcctcccactagcaaacccaaagctgaactcaaactcagccgcagcttgtccaagtctgactctgatctcctgacctgctcacccacagaggacgctaccatggggagtcggagtgagtccttatccaactgcagcattgggaagaaaaggctagagaagtcaccctccttcgcctcggagtgggatgagattgagaaaatcatgagttctattggagaagggattgacttttctcaggaacggcagaagatctcaggtttacggacgctggagcagagtgtcggggagtggctggagtcgattgggctgcagcagtatgagagcaagttgcttctgaatggctttgacgatgtccacttcctggggtctaatgtgatggaagagcaggacctgcgggacatcggcatcagcgacccacagcaccggcggaagctgctccaggcggcacgctccctacccaaggtgaaggctctgggttatgacgggaacagcccccctagcgtgccctcctggctggactccctggggctgcaggactacgtccattccttcttgtcaagtggttacagctccattgacaccgtgaagaacctctgggagctagagctcgtcaatgtcctgaaggtccagctgctcggccatcgcaagcgcatcatcgcctccctcgcagacagaccgtacgaggagccgccccagaagccccccagattctcccagctgaggtgccaagatttgctctcccagacgtcatccccactgagtcagaatgattcctgcactgggcggtcggcagatctgctgctgcctccaggggacacaggcaggaggcgccatgacagtctccatgaccctgcggcaccctcccgagcggagcgcttcaggatccaggaggagcaccgtgaggccaagctgaccctgcggcccccgagcctggcagccccctacgccccagtgcagagttggcaacaccagccagagaaactcatcttcgagtcctgtggttatgaagccaattatctgggctccatgctgatcaaagatctgcgagggacagaatccacgcaagacgcctgtgccaagatgcggaaatctacggagcacatgaagaagatccccaccatcatcctgtccatcacatacaaaggtgtcaagttcatcgatgcctccaacaagaacgtcattgcagagcacgagatccggaacatttcctgtgcggcccaggacccggaggacctctgtacctttgcctacatcaccaaggacctgcagaccagccaccactattgccatgtgttcagcaccgtggatgtgaacctgacctacgagatcatcctgacgctggggcaggccttcgaagtggcctatcagttggccctgcaggcccagaagtccagggcgacgggcgcctctgcagctgagatgattgaaacaaaatcttccaaaccggtgcctaagcctcgggtcggcgtgaggaaatccgcactggaaccacctgatatggaccaagatgcccaatcccatgccagtgtctcctgggttgtggaccccaaaccagactctaagcggagcctcagcaccaactga

SEQ ID NO: 6455 - DNA, 382 bp, Artificial Sequence; identical to SEQ ID NO: 434
  Synthetic polypeptide

SEQ ID NO: 6456 - DNA, 396 bp, Artificial Sequence
  Synthetic polypeptide
ccatcaccaagcggtgagactatcacctatcgccaagtggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6457 - DNA, 564 bp, Artificial Sequence
  Synthetic polypeptide
ccatcaccaagcggtgagactatcacctatcgccaagtggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6458 - DNA, 624 bp, Artificial Sequence
  Synthetic polypeptide
ccatcaccaagcggtgagactatcacctatcgccaagtggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6459 - DNA, 516 bp, Artificial Sequence
  Synthetic polypeptide
ccatcaccaagcggtgagactatcacctatcgccaagtggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6460 - DNA, 507 bp, Artificial Sequence
  Synthetic polypeptide
ccatcaccaagcggtgagactatcacctatcgccaagtggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttga

SEQ ID NO: 6461 - DNA, 163 bp, Artificial Sequence; identical to SEQ ID NO: 480
  Synthetic polypeptide

SEQ ID NO: 6462 - DNA, 104 bp, Artificial Sequence; identical to SEQ ID NO: 481
  Synthetic polypeptide

SEQ ID NO: 6463 - DNA, 201 bp, Artificial Sequence
  Synthetic polypeptide
gaaataaaatcaacaggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctga

SEQ ID NO: 6464 - DNA, 159 bp, Artificial Sequence
  Synthetic polypeptide
gaaataaaatcaacaggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggtga

SEQ ID NO: 6465 - DNA, 694 bp, Artificial Sequence
  Synthetic polypeptide
ccttcctcttggtcctctgactctgcccacctccttccttttgtcccccgctgccaacgtcatcctctccaattccgctccctctcctccccagccctcaccttggagcctcccatgaggggccttgcttgctcttgattttgtgactgtgatcatctctgccccatgcacacattttatttcccatgtgagactgctcagatacttttttgtcttctccttgcatcctctgagagcactggacacagtgccagacacactggagaatgggggcgacatggtccacctgaaagatcttaacacccaggctgtgagatttgggctgctctttaaccaggagaatacaacttattcgaaaacgattgctctatatggattcttctttaagataaagggactcaaacatgatactacctcttatagtttttacatgcagagaataaagcacacagacctggaatctccctctgcggtctacgagcacaaccacgtcagcctgcgagcggcacgcctggtgaagtatgagatcagagcagaggccctggttgacggcaagtggcaggagttcaggacaaaccagatcaagcagaagtttgggttgaccacgtcatcctgcaaaagccataccttgaaaatccaaactgtgggcatcccaatctatgtaagttttgcattcatcttcccagcatcttga

SEQ ID NO: 6466 - DNA, 871 bp, Artificial Sequence; identical to SEQ ID NO: 437
  Synthetic polypeptide

SEQ ID NO: 6467 - DNA, 421 bp, Artificial Sequence; identical to SEQ ID NO: 441
  Synthetic polypeptide

SEQ ID NO: 6468 - DNA, 638 bp, Artificial Sequence; identical to SEQ ID NO: 442
  Synthetic polypeptide

SEQ ID NO: 6469 - DNA, 337 bp, Artificial Sequence; identical to SEQ ID NO: 443
  Synthetic polypeptide

SEQ ID NO: 6470 - DNA, 742 bp, Artificial Sequence; identical to SEQ ID NO: 6357
  Synthetic polypeptide

SEQ ID NO: 6471 - DNA, 590 bp, Artificial Sequence; identical to SEQ ID NO: 6358
  Synthetic polypeptide

SEQ ID NO: 6472 - DNA, 577 bp, Artificial Sequence; identical to SEQ ID NO: 6359
  Synthetic polypeptide

SEQ ID NO: 6473 - DNA, 430 bp, Artificial Sequence; identical to SEQ ID NO: 6360
  Synthetic polypeptide

SEQ ID NO: 6474 - DNA, 670 bp, Artificial Sequence; identical to SEQ ID NO: 6361
  Synthetic polypeptide

SEQ ID NO: 6475 - DNA, 665 bp, Artificial Sequence; identical to SEQ ID NO: 6374
  Synthetic polypeptide

SEQ ID NO: 6476 - DNA, 518 bp, Artificial Sequence; identical to SEQ ID NO: 6375
  Synthetic polypeptide

SEQ ID NO: 6477 - DNA, 285 bp, Artificial Sequence
  Synthetic polypeptide
cagaggaagaggccgtggagctgacgcctggagtcaggctgtactcaggggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataa

SEQ ID NO: 6478 - DNA, 3021 bp, Artificial Sequence; identical to SEQ ID NO: 449
  Synthetic polypeptide

SEQ ID NO: 6479 - DNA, 3075 bp, Artificial Sequence; identical to SEQ ID NO: 450
  Synthetic polypeptide

SEQ ID NO: 6480 - DNA, 1143 bp, Artificial Sequence; identical to SEQ ID NO: 451
  Synthetic polypeptide

SEQ ID NO: 6481 - DNA, 414 bp, Artificial Sequence
  Synthetic polypeptide
ggcggcggcggagcgggcggcggagcggcggcagcagcgaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccctggatcccgccctcctcccccaccaccttccaccacctccaccgcccacagcccacgtggcccccaggagcacagcaggggggcgcccagcagaaagccatggcggccatggacggccagagatga

SEQ ID NO: 6482 - DNA, 368 bp, Artificial Sequence
  Synthetic polypeptide
ggccaggcgtgggggctcatgcctgtaattccagcacttcgggaggccgaggcaggcggatcacccgagtgtttgattgcatcgaggtctatgcccctggcttcaaggactctgtggttggcagagacatcctcacaccaccagatttggagagaatcttcgggcttcctggagggaacatattccactgcgccatgtccctggaccagctctacttcgcccgccccgtgcccctgcattctggctaccgctgccctctccagggcctgtatctctgtggaagtggggctcatcctggaggaggtgtgatgggagctgctgggcgaaatgcagcacatgtggcctttagggacctcaagagcatgtga

SEQ ID NO: 6483 - DNA, 337 bp, Artificial Sequence; identical to SEQ ID NO: 6393
  Synthetic polypeptide

SEQ ID NO: 6484 - DNA, 326 bp, Artificial Sequence
  Synthetic polypeptide
acttaagcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgctgccatccttgcgctgctccctgcactcggcctgctgctctggggacccggccagctctag

SEQ ID NO: 6485 - DNA, 146 bp, Artificial Sequence
  Synthetic polypeptide
acttaagcactgccctgctgtgctactcctgcaaagcccaggtgagcaacgaggactgcctgcaggtggagaactgcacccagctgggggagcagtgctggaccgcgcgcatccgtgagtggggggacgacagccgccaggcctag

SEQ ID NO: 6486 - DNA, 769 bp, Artificial Sequence
  Synthetic polypeptide
gaactcgggcaagttatttaacacccctgagcttctttcttcatctgcaaaatggaacccctccccttcctttgaattgctgagcccattacgcgaggtgacggcggaatcccgctgtaagctgctcagctggctgatcccggtgcaccgccaattcggcctctccttcgagtcgctgtgcctgacggtgaacactctggaccgcttcctcaccaccacgccggtggctgcagactgcttccagctgcttggggtcacctccttgctcatcgcttgcaaacaggtggaggtgcacccgccgcgcgtgaagcagcttctggccctctgctgcggcgccttctcccggcagcagctctgcaacctcgagtgcatcgtgctgcacaagctgcacttcaccctgggtgcgcccaccattagcttcttcctggagcatttcacgcacgctcgcgtggaggcggggcaggctgaggcctccgaagctctggaagcgcaagccctggcgcggggggtggcagagctgagtctggccgactatgccttcaccagctactccccttccctcctggcgatctgctgcctggcgctggcggaccgcatgctgcgggtctcgcggcccgtggacttgcgactgggagaccacccggaggcggcgctggaggactgtatgggcaagttgcagctgctggtggccataaacagtacttccttgactcacatgctgcccgttcagatctgcgagaagtgcagcctgcccccgagctcgaaataa

SEQ ID NO: 6487 - DNA, 1148 bp, Artificial Sequence; identical to SEQ ID NO: 436
  Synthetic polypeptide

SEQ ID NO: 6488 - DNA, 431 bp, Artificial Sequence
  Synthetic polypeptide
caaaaaggcagctatgtagggtggaaagaacagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtga

SEQ ID NO: 6489 - DNA, 302 bp, Artificial Sequence
  Synthetic polypeptide
caaaaaggcagctatgtagggtggaaagaacagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcggtga

SEQ ID NO: 6490 - DNA, 330 bp, Artificial Sequence
  Synthetic polypeptide
ttagatgagataaggagttattactaattttgttaggtgtgacaatgacatagtagttttgtaactactgtcattactatatcaagtactatatcaataatgataaggtctttatcatttggaacttgtaggtgacatgacatgagaattgccttaaaatactcaaggaaaaaaatcctactgctgggtgtgggaggtgcttgatgaaatgagatctgcaaattgttaatagtgattcctgagtgagcacatatacagtactgtagtcttgaagagaaaattcagtctccaacagaagaaacagaaatcttttatcacagaggggtgtag

SEQ ID NO: 6491 - DNA, 2319 bp, Artificial Sequence; identical to SEQ ID NO: 6366
  Synthetic polypeptide

SEQ ID NO: 6492 - DNA, 369 bp, Artificial Sequence
  Synthetic polypeptide
ggccaggcgcggcggctcatgcctgtaatcccagcactttgggaggccaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtga

SEQ ID NO: 6493 - DNA, 171 bp, Artificial Sequence
  Synthetic polypeptide
ggccgcacgcagtggctcgcacctataatcccagcacttcagggggccaaggcaggatttgctatgtattttggatatgggatcccacacagcttggagaacaatcaacagccaccagcgtcaagctcccaaactcctcatgaaaacatccctagtcccttgctgaattag

SEQ ID NO: 6494 - DNA, 243 bp, Artificial Sequence
  Synthetic polypeptide
gccggccgcggtggctcacgcctgtaatcccagcactttgggaggccgagatgggcggatcatgaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactga

SEQ ID NO: 6495 - DNA, 2533 bp, Artificial Sequence
  Synthetic polypeptide
tgagagacacgactagctggatttcctaggccgactaaggaatccccaagcctagctgggaaagtgaccgcttccacctttaaacatgggacttgcaacttagctcacacccgaccaatcagatagtaaggagagctcactaaaatgctaattaggcaaaaacaggaggtaaagaaatagccatctgctgcctgagagcacagcaggagggacaatgatcaggatataaacccaggcattcgagccagcaatggcaaccccctttgggtcccctccctttgtacgggagctctgttttcactgtgtttcactctattaaatcttgcaactgcactcttctggtccatgtttgttacagctcgagctgagctttcgcttgccgtccaccactgcccaccactgtcgtttgctgccatcgcagacctgctgctgacttccatccctctggatccggcaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagaaaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaagaggagaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatag

SEQ ID NO: 6496 - DNA, 543 bp, Artificial Sequence
  Synthetic polypeptide
tagagtgtgagcagagtgaaatgctgcttccaggcctgacccatcaaaacctcagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctag

SEQ ID NO: 6497 - DNA, 378 bp, Artificial Sequence
  Synthetic polypeptide
tagagtgtgagcagagtgaaatgctgcttccaggcctgacccatcaaaacctcagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaagctcacgtaatgcctgctggcgctgaccacacagctccttcctcctctcccagcactggcacgaagtgctccctgctgcgtcatcaccatctcgggacgcatgaccttcacgagcaataa

SEQ ID NO: 6498 - DNA, 267 bp, Artificial Sequence
  Synthetic polypeptide
tagagtgtgagcagagtgaaatgctgcttccaggcctgacccatcaaaacctcagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaagctccttag

SEQ ID NO: 6499 - DNA, 416 bp, Artificial Sequence
  Synthetic polypeptide
tagagtgtgagcagagtgaaatgctgcttccaggcctgacccatcaaaacctcagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaagg

SEQ ID NO: 6500 - DNA, 162 bp, Artificial Sequence
  Synthetic polypeptide
tagagtgtgagcagagtgaaatgctgcttccaggcctgacccatcaaaacctcagagccgaacactgtcagctacagccagtccagcttgatccacctggtggggccttcagactgcaccctgcacggctttgtgcacggaggaggagttgactttcactga

SEQ ID NO: 6501 - DNA, 950 bp, Artificial Sequence
  Synthetic polypeptide
agccaagcgtggtggtgcatgcctgtggtcccagctactcaggaggctgagccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactag

SEQ ID NO: 6502 - DNA, 269 bp, Artificial Sequence
  Synthetic polypeptide
agccaagcgtggtggtgcatgcctgtggtcccagctactcaggaggctgagccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaaccgcccaggtttgctga

SEQ ID NO: 6503 - DNA, 1883 bp, Artificial Sequence; identical to SEQ ID NO: 6345
  Synthetic polypeptide

SEQ ID NO: 6504 - DNA, 365 bp, Artificial Sequence
  Synthetic polypeptide
agttgacccttgaacaacataggtgtgaactgtgagtccacttaagtggcttctctttcgcctctgccacccctgagacagcaggaccaaccctcccttcctcctcctcagcctgctctacgtgaagatgatgaggatgaagacctttatgacgatccacttccacttaatgaaaagtgaatgaaaactttgccattgatttgatagcagagcagcccgtgagcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactag

SEQ ID NO: 6505 - DNA, 509 bp, Artificial Sequence
  Synthetic polypeptide
agttgacccttgaacaacataggtgtgaactgtgagtccacttaagtggcttctctttcgcctctgccacccctgagacagcaggaccaaccctcccttcctcctcctcagcctgctctacgtgaagatgatgaggatgaagacctttatgacgatccacttccacttaatgaaaagtgaatgaaaactttgccattgatttgatagcagagcagcccgtgagcgaggtggagactcgggtgatagcgtgcgatggcggcgggggagctcttggccacccaaaagtgtatataaacttggtgcgtagctggccacctgtgcacatgttagggcagcctgctcgtcctcatactccccttcactcccagtgcctgttctttctgtcctcttctctacctgctcccgaggcggcccttacggggttcacactgctggcacattcaccctacagcgccacactacagggcctacatagagccgcctgtccgaaaaccccctttcaactgtga

SEQ ID NO: 6506 - DNA, 148 bp, Artificial Sequence; identical to SEQ ID NO: 6388
  Synthetic polypeptide

SEQ ID NO: 6507 - DNA, 1100 bp, Artificial Sequence; identical to SEQ ID NO: 6389
  Synthetic polypeptide

SEQ ID NO: 6508 - DNA, 464 bp, Artificial Sequence; identical to SEQ ID NO: 6390
  Synthetic polypeptide

SEQ ID NO: 6509 - DNA, 280 bp, Artificial Sequence; identical to SEQ ID NO: 6391
  Synthetic polypeptide

SEQ ID NO: 6510 - DNA, 459 bp, Artificial Sequence
  Synthetic polypeptide
gccgggcatggtggctcacgcctgtaatcccagcactttgggaggccgaggtgggcggatcacctgaggtcgggagttcgagaccagcctgaccaacatggtgaaacctcatctccactaaaaatacaaaattagccaggcgtgatggtgcgtgcctgtaatcccagctactcgggaggctgaggcaggagaatcgcttgaacctgggaggcagagctggtgttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactga

SEQ ID NO: 6511 - DNA, 504 bp, Artificial Sequence
  Synthetic polypeptide
gccgggcatggtggctcacgcctgtaatcccagcactttgggaggccgaggtgggcggatcacctgaggtcgggagttcgagaccagcctgaccaacatggtgaaacctcatctccactaaaaatacaaaattagccaggcgtgatggtgcgtgcctgtaatcccagctactcgggaggctgaggcaggagaatcgcttgaacctgggaggcagagctggtgttctctgtggacattgactcggagctggtggaggagctgccggccgaaatcgagctgtggctggtgctggtggccgtgggtgcagggctgctgctgctggggctgatcatcctcctgctgtggaagtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactga

SEQ ID NO: 6512 - DNA, 1423 bp, Artificial Sequence
  Synthetic polypeptide
ccctgtgtgccttggtcaccccatctggcagttgacagtaacagggcctttctcacaatgctgttgggagatgaggcacagttcctggcatatcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctga

SEQ ID NO: 6513 - DNA, 540 bp, Artificial Sequence
  Synthetic polypeptide
caaaaaaaaatactgcattttctcacttaaaaagtaggagctaaatgatgagaacacgtggacacatggagaagaacaacacacagtggggcctttcagagggtggagagtgggaagagggagaggatcagaaaaaataactaacaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtgatccagagactccatga

SEQ ID NO: 6514 - DNA, 651 bp, Artificial Sequence
  Synthetic polypeptide
caaaaaaaaatactgcattttctcacttaaaaagtaggagctaaatgatgagaacacgtggacacatggagaagaacaacacacagtggggcctttcagagggtggagagtgggaagagggagaggatcagaaaaaataactaacaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataa

SEQ ID NO: 6515 - DNA, 569 bp, Artificial Sequence
  Synthetic polypeptide
caaaaaaaaatactgcattttctcacttaaaaagtaggagctaaatgatgagaacacgtggacacatggagaagaacaacacacagtggggcctttcagagggtggagagtgggaagagggagaggatcagaaaaaataactaacaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtaaagcacaacatcaggaagtgtgtttgaaagaagtacaaaatagtct

SEQ ID NO: 6516 - DNA, 152 bp, Artificial Sequence
  Synthetic polypeptide
caaaaaaaaatactgcattttctcacttaaaaagtaggagctaaatgatgagaacacgtggacacatggagaagaacaacacacagtggggcctttcagagggtggagagtgggaagagggagaggatcagaaaaaataactaacaggttga

SEQ ID NO: 6517 - DNA, 488 bp, Artificial Sequence
  Synthetic polypeptide
aagttacagaaagaaagattgtagattaccatcaggaagaactctgtaactgtcagagccatctaaagatgaaaacgtttgacctggaatgatatttgtccagtcattgtgccacaacattcaaagaagatggattatggacttacctcaatcagattgtggcctgttccccttgggttttatatatcttgatgctagcaactttccatttctcatggtcaacatttttattattaaatcaactctttcagattgcctttctgggcctgacctcccatgagagaatcagcctgcagaagcagagcaagcatatgaaacagacgttgtccctcaggaagacaccatacaatcttggattcatgcagaacctggcagatttctttcagtgtggctgctttggcttggtgaagccctgtgtggtagattggacatcacagtacaccatggtctttcacccagccagggagaaggttcttcgctcagtatga

SEQ ID NO: 6518 - DNA, 2471 bp, Artificial Sequence; identical to SEQ ID NO: 576
  Synthetic polypeptide

SEQ ID NO: 6519 - DNA, 427 bp, Artificial Sequence; identical to SEQ ID NO: 573
  Synthetic polypeptide

SEQ ID NO: 6520 - DNA, 347 bp, Artificial Sequence; identical to SEQ ID NO: 452
  Synthetic polypeptide

SEQ ID NO: 6521 - DNA, 148 bp, Artificial Sequence; identical to SEQ ID NO: 454
  Synthetic polypeptide

SEQ ID NO: 6522 - DNA, 370 bp, Artificial Sequence
  Synthetic polypeptide
gggggaggagccaagatggccgaataggaacagctccggtctacagctcccagcgtgagcagaagacggcgatttctgcatttccatctgaggtaattggtatgtgaaaaagtgtctaaacgacgttggaatttgcaagaagaagtgcaaacctgaagagatgcatgtaaagaatggttgggcaatgtgcggcaaacaaagggactgctgtgttccagctgacagacgtgctaattatcctgttttctgtgtccagacaaagactacaagaatttcaacagtaacagcaacaacagcaacaacaactttgatgatgactactgcttcgatgtcttcgatggctcctacccccgtttctcccactggttga

SEQ ID NO: 6523 - DNA, 829 bp, Artificial Sequence; identical to SEQ ID NO: 624
  Synthetic polypeptide

SEQ ID NO: 6524 - DNA, 1331 bp, Artificial Sequence; identical to SEQ ID NO: 550
  Synthetic polypeptide

SEQ ID NO: 6525 - DNA, 1028 bp, Artificial Sequence; identical to SEQ ID NO: 551
  Synthetic polypeptide

SEQ ID NO: 6526 - DNA, 1295 bp, Artificial Sequence; identical to SEQ ID NO: 553
  Synthetic polypeptide

SEQ ID NO: 6527 - DNA, 1322 bp, Artificial Sequence; identical to SEQ ID NO: 554
  Synthetic polypeptide

SEQ ID NO: 6528 - DNA, 1013 bp, Artificial Sequence; identical to SEQ ID NO: 555
  Synthetic polypeptide

SEQ ID NO: 6529 - DNA, 229 bp, Artificial Sequence
  Synthetic polypeptide
gccaggtccccctgttgcctgttctcctctggtcagcatctctgcacatgtttacctgatgatgcagatgaccactgagacctgggcccaatgtggagtctggatgttgattggatttgctatgtattttggatatgggatcccacacagcttggagaacaatcaacagccaccagcgtcaagctcccaaactcctcatgaaaacatccctagtcccttgctgaattag

SEQ ID NO: 6530 - DNA, 529 bp, Artificial Sequence
  Synthetic polypeptide
tttcttggttccctgaccggcaagcgaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaa

SEQ ID NO: 6531 - DNA, 523 bp, Artificial Sequence
  Synthetic polypeptide
tttcttggttccctgaccggcaagcgaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagagaagggaaaatggagacacaggagtggggagagtttgagaagatggtag

SEQ ID NO: 6532 - DNA, 1077 bp, Artificial Sequence
  Synthetic polypeptide
aggcaggagaatagtagagggaagtgaaggggcaggtgaacacaaagcaagagaagaagcagaagttgagcagccaaaacaaaagggagataagcaagtaagagaccccatggccggcaagatccagaccagaccagtaaaggctcatttgtgagaactaaaatagatactacggagaacttgctcaacacagaggtgcacagctcgccagcgcagcgctggtccatgcaggtgccacccgaggtgagcgcggaggcaggcgacgcggcagtgctgccctgcaccttcacgcacccgcaccgccactacgacgggccgctgacggccatctggcgcgcgggcgagccctatgcgggcccgcaggtgttccgctgcgctgcggcgcggggcagcgagctctgccagacggcgctgagcctgcacggccgcttccggctgctgggcaacccgcgccgcaacgacctctcgctgcgcgtcgagcgcctcgccctggctgacgaccgccgctacttctgccgcgtcgagttcgccggcgacgtccatgaccgctacgagagccgccacggcgtccggctgcacgtgacagccgcgccgcggatcgtcaacatctcggtgctgcccagtccggctcacgccttccgcgcgctctgcactgccgaaggggagccgccgcccgccctcgcctggtccggcccggccctgggcaacagcttggcagccgtgcggagcccgcgtgagggtcacggccacctagtgaccgccgaactgcccgcactgacccatgacggccgctacacgtgtacggccgccaacagcctgggccgctccgaggccagcgtctacctgttccgcttccatggcgccagcggggcctcgacggtcgccctcctgctcggcgctctcggcttcaaggcgctgctgctgctcggggtcctggccgcccgcgctgcccgccgccgcccagagcatctggacaccccggacaccccaccacggtcccaggcccaggagtccaattatgaaaatttgagccagatgaacccccggagcccaccagccaccatgtgctcaccgtga

SEQ ID NO: 6533 - DNA, 463 bp, Artificial Sequence; identical to SEQ ID NO: 524
  Synthetic polypeptide

SEQ ID NO: 6534 - DNA, 842 bp, Artificial Sequence
  Synthetic polypeptide
caaacaactgataaacacagcaacatggatgaacttcaaaaacactaagcaaaagaagccagacacaaaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttttttgggcgtgtgcttagggatgcagttggcagtggttgaattctcaagaaacgtgctgggatggcaagatgccaattctacagagtttgaccctacgaccagtcatcccgtggtcgtagacatgccagaacacaacccagggcagatgggcggaaccatgaggctgggcaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactga

SEQ ID NO: 6535 - DNA, 844 bp, Artificial Sequence
  Synthetic polypeptide
aatctcaatttctacatctataaaagtaaggactatatcctaactttgcaggatggttgtgtggaattaaatgaaaaaatctacagaaaacatcttgggaacacctggcacatagttatttacctttagtgaattccatcttctgaaaacaatgcttttgtgggtcttcttgcaactgaactacaagattcaggcaattccgacttatgaaaccgtgatgacattttttaagagctttcctgagaactgttgctttctggaccgggacataggacggagcttgaggccgctcttcctctgcttgcgtctgcacggcatcaccaaaggcaaggatctggaggtgctgcggcaccttaacttcttcccagagtcatggctcgaccaggttacagtcaaccattaccacgcactggagaatgggggcgacatggtccacctgaaagatcttaacacccaggctgtgagatttgggctgctctttaaccaggagaatacaacttattcgaaaacgattgctctatatggattcttctttaagataaagggactcaaacatgatactacctcttatagtttttacatgcagagaataaagcacacagacctggaatctccctctgcggtctacgagcacaaccacgtcagcctgcgagcggcacgcctggtgaagtatgagatcagagcagaggccctggttgacggcaagtggcaggagttcaggacaaaccagatcaagcagaagtttgggttgaccacgtcatcctgcaaaagccataccttgaaaatccaaactgtgggcatcccaatctatgtaagttttgcattcatcttcccagcatcttga

SEQ ID NO: 6536 - DNA, 309 bp, Artificial Sequence
  Synthetic polypeptide
ccctggagccaggcgagcccacgtttgagtttcaaatctcccacctcctggctgtgtgtcctcagccaagaggctctgaagtcactgcaggagcggcggcgggagcaggagctgctggagcagtacgtgagcaccgtgaacgaccgcagtgacatcgtggactcgctggacgaggaccggctccgggaacaagaggaggatcagatgctgcgggacatgattgagaagctgggcctccagaggaagaagtccaagttccgcttgtccaagatctggtcaccaaaaagcaaaagcagcccctcccagtag

SEQ ID NO: 6537 - DNA, 1647 bp, Artificial Sequence
  Synthetic polypeptide
caaaatatccttcttgggccaaaaacattgacatcattggggccattgcaatttagagacgtggccatagaattctctctggaggagtggcattgcctggacactgcacagcggaatttatataggaatgtgatgttagagaactacagaaacctggtcttccttggtattgttgtctctaagccagacctcatcacctgtctggagcaaggaaaaaaacctttgaccatgaagaaacatgagatggtagccaacccctcagttacgtgttctcattttgcccgagatctttggccagagcagagcataaaagattctttccaaaaagtgacactgagaagatatgaaaactatggacatgacaatttacagtttaaaaagggctgtgaaagtgtagatgagtgtaaggtgcacaaaagaggttataatggacttaaccaatatttgacaactactcaaagcaaaatatttcagtgtgataaatatgtgaaagtcattcataaattttcaaattcaaacagacataagataagacatactggaaaaaaacctttcaaatgtatagaatgtggcaaagcttttaaccagtcttcaacccttactacacataagaaaattcatactggggagaaacccttcaaatgtgaagaatgtggcaaagccttcaactggtcctcacaccttactacacataagagaattcatactggagagaaacggtacaaatgtgaagactgtggcaaagcctttagccggttttcataccttactgcacataagataattcatagtggagagaaaccctacaaatgtgaagaatgtggcaaggcctttaagcgctcctctaaccttactacacataagataattcatactggagagaaaccctacaaatgtgaagaatgtggcaaggcctttaagcgctcctctatccttactgcgcataagataattcatagcggagagaaaccctacaaatgtgaagaatgtggcaaagcctttaagcacccctctgtccttactacacataaaagaattcatactggagagaaaccctacaaatgtgaagaatgtggcagagcctttaagtacttctcatcccttactacacacaagataattcatagtggagagaaaccctacaaatgtgaagaatgtggcaaagccttcaactggtcctcacaccttactacacataagagaattcatactggagagaaaccctacaaatgtgaagaatgtggcgaagcctttaagtactcctcttcccttactacacataagataatccatactggacagcaacccttcaagtgtgaagaatgtggcaaggcctttaagtgcttctctatccttactacacataagagaattcatactggagagaaaccctacaaatgtgaagaatgtggcaaagccttcaactcgtcctcacaccttactgcacataagagaattcatactggagagaaaccctacaaatgtgaacgatgtggcaaggcttttaagcgctcctttatccttactagacataagagaattcatactggagagaaaccctacaaatgtgaagaatgtggcaaaggctttaagtgcccctctacccttactacacataaggtaattcatactggagagaaactataa

SEQ ID NO: 6538 - DNA, 70 bp, Artificial Sequence
  Synthetic polypeptide
caaaatatccttcttgggccaaaaacattgacatcattggggccattgcaatttagagacgtggccatag

SEQ ID NO: 6539 - DNA, 432 bp, Artificial Sequence
  Synthetic polypeptide
caaaatatccttcttgggccaaaaacattgacatcattggggccattgcaatttagagacgtggccatagaattctctctggaggagtggcattgcctggacactgcacagcggaatttatataggaatgtgatgttagagaactacagaaacctggtcttccttggtattgttgtctctaagccagacctcatcacctgtctggagcaaggaaaaaaacctttgaccatgaagaaacatgagatggtagccaacccctcagagactgggtttcaccatgttggcaagggtggtctcaaactcctgacctcagatgatctgcctgcctcggcctcccaaagtactggaattacaggcatgaggcaccccgcccggcccaattgtgtgggcttctatgtaggcagaactgaccataaactgtggctcaggtaa

SEQ ID NO: 6540 - DNA, 943 bp, Artificial Sequence
  Synthetic polypeptide
tgcaggagacacctgaagcttctgccacccaatatcaattcacctttcttctaaaatattacggtgttatgtatgattcccctttggggaccaccccctttcctgttctcagcccagtctcagtctcttcctggttgagttgactccatctccggctgcagggatgggcatgtgactcaagcttggccaatcagagcacagcagtcccccggaccacactaattggcttagaaacgggcctgtgagtcaatcagagaaaatgagaagccatgaggcctttgggagaatcttaggaaaaaattctctctcatccccttgggattcaaagctgagaagatgtaaggactggagctgcagcagtctttctgggaccattatacagagattctgtctgaggttggatccacgtggtcaaaagtattgctgaggagccagagagagactgaggtctgatgacatcacttgagccctgcagacttttcatttacgggaaaacagagaggatgaaggcctatctaaagagcgcagaaggcttttttgtcctaaataaaagtaccacaattggaaggcatgaaaattcagaccttgttttacaggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaagtgtggaccaatgccatgaaactgtcagaaaaatcagtggccgaggggattcctggggcagttccccctgcggagattta

SEQ ID NO: 6541 - DNA, 2812 bp, Artificial Sequence
  Synthetic polypeptide
tttcttggttccctgaccgggaagcaaggtgattaacagatggtcgaggcagctccttaggcggctttagcctgccctgtggaacatccctgctggggactccaaccagccagagtgacgcggatcctgagagctctcctgggtaggcatttgccccggtgggacacctcgccagagcagtgtgtggcaggcccccgtggaggatcaacagagtggctgaacaccgggaaggaattggcacttggagtccggacaactaaaacttggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataa

SEQ ID NO: 6542 - DNA, 1588 bp, Artificial Sequence
  Synthetic polypeptide
tttcttggttccctgaccgggaagcaaggtgattaacagatggtcgaggcagctccttaggcggctttagcctgccctgtggaacatccctgctggggactccaaccagccagagtgacgcggatcctgagagctctcctgggtaggcatttgccccggtgggacacctcgccagagcagtgtgtggcaggcccccgtggaggatcaacagagtggctgaacaccgggaaggaattggcacttggagtccggacaactaaaacttggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctggtcccctgaagtcatgggttgctggctcctgctcagagtga

SEQ ID NO: 6543 - DNA, 2932 bp, Artificial Sequence
  Synthetic polypeptide
tttcttggttccctgaccgggaagcaaggtgattaacagatggtcgaggcagctccttaggcggctttagcctgccctgtggaacatccctgctggggactccaaccagccagagtgacgcggatcctgagagctctcctgggtaggcatttgccccggtgggacacctcgccagagcagtgtgtggcaggcccccgtggaggatcaacagagtggctgaacaccgggaaggaattggcacttggagtccggacaactaaaacttggaagaagagaatttatccaaagattaaaacttgaagcaacccttaatgtgcatgatggttgtgttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgaatttttaaggggccctgagatagctttgcttcgtaagcgcctgcaacaactgaggcttaagaaggctgagcagcagaggcagcaagagctagctgcacatacccagcaacagccttccacttctgatcagtcttctcatgagggctcttcacaggaccctcatgcttcagattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagatttaatatcagaggaacaacaataggtgatagaataatgagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataa

SEQ ID NO: 6544 - DNA, 2752 bp, Artificial Sequence
  Synthetic polypeptide
tttcttggttccctgaccgggaagcaaggtgattaacagatggtcgaggcagctccttaggcggctttagcctgccctgtggaacatccctgctggggactccaaccagccagagtgacgcggatcctgagagctctcctgggtaggcatttgccccggtgggacacctcgccagagcagtgtgtggcaggcccccgtggaggatcaacagagtggctgaacaccgggaaggaattggcacttggagtccggacaactaaaacttggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataa

SEQ ID NO: 6545 - DNA, 3025 bp, Artificial Sequence
  Synthetic polypeptide
tttcttggttccctgaccgggaagcaaggtgattaacagatggtcgaggcagctccttaggcggctttagcctgccctgtggaacatccctgctggggactccaaccagccagagtgacgcggatcctgagagctctcctgggtaggcatttgccccggtgggacacctcgccagagcagtgtgtggcaggcccccgtggaggatcaacagagtggctgaacaccgggaaggaattggcacttggagtccggacaactaaaacttggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgaatttttaaggggccctgagatagctttgcttcgtaagcgcctgcaacaactgaggcttaagaaggctgagcagcagaggcagcaagagctagctgcacatacccagcaacagccttccacttctgatcagtcttctcatgagggctcttcacaggaccctcatgcttcagattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagatttaatatcagaggaacaacaataggtgatagaataatgagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataa

SEQ ID NO: 6546 - DNA, 275 bp, Artificial Sequence
  Synthetic polypeptide
gccggccgcggtggctcacgcctgtaatcccagcactttgggaggccgagatgggcggatcatgaggtcaggagatcgagaccatcttggctaacacggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactga

SEQ ID NO: 6547 - DNA, 1209 bp, Artificial Sequence
  Synthetic polypeptide
ggctgggcatggtggctcacacctgtaatctcagcactttgggaagctgaggcaggaggatcacttgaggccaggagttcaagaccagcctgagcaacatagagagatcctgtctctaaacaaaattttaaaaattagccagtaaccatggacccaaacgtgttgagaagtgatgtcttcgttgagtttttaaaactggcgcagctgaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaagttctgaggtggaaaactgtaaggttggactccgaaagtggtatatggctccatccctcgactccgtgctgatggactgcagggtggcggtagatttgctctacatgcaggcaatacaggacattgaaaaaggatgggccaaacccacacaggcacagaggcagaaattagaagctttccagaaagaagacagtcaaacaaagtttttggagctggcccgggaggtacggcactatggatacctgcagctggatccttgtacctgtgactacccagaatcaggctctggagctgttctttctgttggcaataatgagatcagctgctgcatcaccctgcctgacagccagacccaggacatcgttttccagatgagcagggtgaagtgctggcaggtcactttccttggaactctgctggatacggatgggccccagagaactctcaaccagaacttagagctcagatttcaatacagtgaggatagttgctggcagtggtttgttatttacaccaaacaggcttttttgctgagtagctgcttgaaaaagatgatctcagaaaagatggtaaagctagctgctgagaatacagaaatgcagattgaagttccggaacaaagcaaaagtaaaaaataccacattcaacaaagccagcagaaagactattctagttttctatcaagaaaaagcaagattaagatagctaaagatgactgcgtttttgggaacataaaggaagaagatctctga

SEQ ID NO: 6548 - DNA, 458 bp, Artificial Sequence
  Synthetic polypeptide
ggctgggcatggtggctcacacctgtaatctcagcactttgggaagctgaggcaggaggatcacttgaggccaggagttcaagaccagcctgagcaacatagagagatcctgtctctaaacaaaattttaaaaattagccagtaaccatggacccaaacgtgttgagaagtgatgtcttcgttgagtttttaaaactggcgcagctgaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaag

SEQ ID NO: 6549 - DNA, 294 bp, Artificial Sequence
  Synthetic polypeptide
ggctgggcatggtggctcacacctgtaatctcagcactttgggaagctgaggcaggaggatcacttgaggccaggagttcaagaccagcctgagcaacatagagagatcctgtctctaaacaaaattttaaaaattagccagtaaccatggacccaaacgtgttgagaagtgatgtcttcgttgagtttttaaaactggcgcagctgaatacatttgacatcgccaccaagaaagcttatctggacatatttctgcccaatgaacagagtattagaatcgaaattataacatca

SEQ ID NO: 6550 - DNA, 423 bp, Artificial Sequence
  Synthetic polypeptide
ggagttagaaggcatcgcctctaatccaggtttcgccatctcctctgctaagtgacgtccagcaagtcacttcactttcaggacctcaaatctcctccccagtagtaaaataggggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatag

SEQ ID NO: 6551 - DNA, 133 bp, Artificial Sequence
  Synthetic polypeptide
taagttaaacatggaaagcgcttagaatggttctggcatgcaaccagttgcacgtgcattatttaatcacatagacaagtcaggattgaaggatagttctgtcgaagaactcaagaaaagatacggtggttga

SEQ ID NO: 6552 - DNA, 386 bp, Artificial Sequence
  Synthetic polypeptide
gccctctccttccttttccttctatatacatgctctcttgcccttctgccttcaaccgtgggatgacacaacatgaaggacctcaccagatgtaagcccctcaaccttggacttctcagcctccagaactttccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatag

SEQ ID NO: 6553 - DNA, 1022 bp, Artificial Sequence; identical to SEQ ID NO: 590
  Synthetic polypeptide

SEQ ID NO: 6554 - DNA, 347 bp, Artificial Sequence; identical to SEQ ID NO: 591
  Synthetic polypeptide

SEQ ID NO: 6555 - DNA, 1109 bp, Artificial Sequence; identical to SEQ ID NO: 592
  Synthetic polypeptide

SEQ ID NO: 6556 - DNA, 85 bp, Artificial Sequence; identical to SEQ ID NO: 601
  Synthetic polypeptide

SEQ ID NO: 6557 - DNA, 269 bp, Artificial Sequence; identical to SEQ ID NO: 600
  Synthetic polypeptide

SEQ ID NO: 6558 - DNA, 3055 bp, Artificial Sequence; identical to SEQ ID NO: 709
  Synthetic polypeptide

SEQ ID NO: 6559 - DNA, 3058 bp, Artificial Sequence; identical to SEQ ID NO: 710
  Synthetic polypeptide

SEQ ID NO: 6560 - DNA, 1221 bp, Artificial Sequence
  Synthetic polypeptide
tgagaggtgacaatatgctagcagcccttgctcactcttggtgcctcctcgtcctccacatccactctggctgcacttgaggagcccttcagcccaccactgcactgtgggggcccctctctggggctggccaaggccgaagccagctccctctgctcgccaggaggtgtggagggagaggcgccggcaggagcccacactgtacagggcactcaccggccagcaggggctccgtgggccggccggtgccagctgggcctgactgggggatgagctccctctgggctgctggagtgcctgggctaggtgccgcaaagtcctgcagtgtgtgccattgagaggtgaagccggctgggcttctgggtccggtggggacctggagaacttttctgtctagctaaaggtttgtaaatgcacccatcagcactctgtgtctagctaaaggtttgtaaatgcaccaatcagcaatctgtgtctagccaatctggtggggacttggagaacttttgtgtctagctaaaggattgtaaatgcaccaatcagcactctgtgtctagctaaaggtttgtaaatgcaccaatcagcactctgtcaaaacggaccaatcagctctctgtaaaacagaccaatcagctctctgtaaaatggaccaatcagctctccataaaatggaccaatcagcaggatgtgggtgtggccagttaagggaataaaagcaggctgcctgagccggcagcagcaacctgctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaaggatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6561 - DNA, 1389 bp, Artificial Sequence
  Synthetic polypeptide
tgagaggtgacaatatgctagcagcccttgctcactcttggtgcctcctcgtcctccacatccactctggctgcacttgaggagcccttcagcccaccactgcactgtgggggcccctctctggggctggccaaggccgaagccagctccctctgctcgccaggaggtgtggagggagaggcgccggcaggagcccacactgtacagggcactcaccggccagcaggggctccgtgggccggccggtgccagctgggcctgactgggggatgagctccctctgggctgctggagtgcctgggctaggtgccgcaaagtcctgcagtgtgtgccattgagaggtgaagccggctgggcttctgggtccggtggggacctggagaacttttctgtctagctaaaggtttgtaaatgcacccatcagcactctgtgtctagctaaaggtttgtaaatgcaccaatcagcaatctgtgtctagccaatctggtggggacttggagaacttttgtgtctagctaaaggattgtaaatgcaccaatcagcactctgtgtctagctaaaggtttgtaaatgcaccaatcagcactctgtcaaaacggaccaatcagctctctgtaaaacagaccaatcagctctctgtaaaatggaccaatcagctctccataaaatggaccaatcagcaggatgtgggtgtggccagttaagggaataaaagcaggctgcctgagccggcagcagcaacctgctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaaggatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6562 - DNA, 1449 bp, Artificial Sequence
  Synthetic polypeptide
tgagaggtgacaatatgctagcagcccttgctcactcttggtgcctcctcgtcctccacatccactctggctgcacttgaggagcccttcagcccaccactgcactgtgggggcccctctctggggctggccaaggccgaagccagctccctctgctcgccaggaggtgtggagggagaggcgccggcaggagcccacactgtacagggcactcaccggccagcaggggctccgtgggccggccggtgccagctgggcctgactgggggatgagctccctctgggctgctggagtgcctgggctaggtgccgcaaagtcctgcagtgtgtgccattgagaggtgaagccggctgggcttctgggtccggtggggacctggagaacttttctgtctagctaaaggtttgtaaatgcacccatcagcactctgtgtctagctaaaggtttgtaaatgcaccaatcagcaatctgtgtctagccaatctggtggggacttggagaacttttgtgtctagctaaaggattgtaaatgcaccaatcagcactctgtgtctagctaaaggtttgtaaatgcaccaatcagcactctgtcaaaacggaccaatcagctctctgtaaaacagaccaatcagctctctgtaaaatggaccaatcagctctccataaaatggaccaatcagcaggatgtgggtgtggccagttaagggaataaaagcaggctgcctgagccggcagcagcaacctgctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaaggatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6563 - DNA, 1341 bp, Artificial Sequence
  Synthetic polypeptide
tgagaggtgacaatatgctagcagcccttgctcactcttggtgcctcctcgtcctccacatccactctggctgcacttgaggagcccttcagcccaccactgcactgtgggggcccctctctggggctggccaaggccgaagccagctccctctgctcgccaggaggtgtggagggagaggcgccggcaggagcccacactgtacagggcactcaccggccagcaggggctccgtgggccggccggtgccagctgggcctgactgggggatgagctccctctgggctgctggagtgcctgggctaggtgccgcaaagtcctgcagtgtgtgccattgagaggtgaagccggctgggcttctgggtccggtggggacctggagaacttttctgtctagctaaaggtttgtaaatgcacccatcagcactctgtgtctagctaaaggtttgtaaatgcaccaatcagcaatctgtgtctagccaatctggtggggacttggagaacttttgtgtctagctaaaggattgtaaatgcaccaatcagcactctgtgtctagctaaaggtttgtaaatgcaccaatcagcactctgtcaaaacggaccaatcagctctctgtaaaacagaccaatcagctctctgtaaaatggaccaatcagctctccataaaatggaccaatcagcaggatgtgggtgtggccagttaagggaataaaagcaggctgcctgagccggcagcagcaacctgctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaaggatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6564 - DNA, 1332 bp, Artificial Sequence
  Synthetic polypeptide
tgagaggtgacaatatgctagcagcccttgctcactcttggtgcctcctcgtcctccacatccactctggctgcacttgaggagcccttcagcccaccactgcactgtgggggcccctctctggggctggccaaggccgaagccagctccctctgctcgccaggaggtgtggagggagaggcgccggcaggagcccacactgtacagggcactcaccggccagcaggggctccgtgggccggccggtgccagctgggcctgactgggggatgagctccctctgggctgctggagtgcctgggctaggtgccgcaaagtcctgcagtgtgtgccattgagaggtgaagccggctgggcttctgggtccggtggggacctggagaacttttctgtctagctaaaggtttgtaaatgcacccatcagcactctgtgtctagctaaaggtttgtaaatgcaccaatcagcaatctgtgtctagccaatctggtggggacttggagaacttttgtgtctagctaaaggattgtaaatgcaccaatcagcactctgtgtctagctaaaggtttgtaaatgcaccaatcagcactctgtcaaaacggaccaatcagctctctgtaaaacagaccaatcagctctctgtaaaatggaccaatcagctctccataaaatggaccaatcagcaggatgtgggtgtggccagttaagggaataaaagcaggctgcctgagccggcagcagcaacctgctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaaggatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttga

SEQ ID NO: 6565 - DNA, 541 bp, Artificial Sequence; identical to SEQ ID NO: 787
  Synthetic polypeptide

SEQ ID NO: 6566 - DNA, 1232 bp, Artificial Sequence
  Synthetic polypeptide
tgataggtttggctgtgtccccaccgaaatctcaacttgaattgtatctcccagaattcccacgtattgtgggagggacctaagaggaggtagttgaatcatgagggccagtttttctcgtgctagtctcgtgatagtaagtctcacgagatctgatgggtttatcaggggtctccgcttttgcttctttctcattttctcttgctgtcgctgcttaagaagagcctttcgcctcccaccatgattgtgagaactcctcagccatgtggaactagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtagtttcagctgtatatgactgtacactcaatttcagaaataatgaaaatccaacactgctgggagtcctaaacggaaagaaataccatgcagatttgtatgttaggaggatcccactggaagacatccctgaagacgatgacgagtgctcggcctggctgcacaagctctaccaggagaaggatgcctttcaggaggagtactacaggacgggcaccttcccagagacgcccatggtgcccccccggcggccctggaccctcgtgaactggctgttttgggcctcgctggtgctctaccctttcttccagttcctggtcagcatgatcaggagcgggtcttccctgacgctggccagcttcatcctcgtcttctttgtggcctccgtgggagttcgatggatgattggtgtgacggaaattgacaagggctctgcctacggcaactctgacagcaagcagaaactgaatgactga

SEQ ID NO: 6567 - DNA, 497 bp, Artificial Sequence
  Synthetic polypeptide
tgataggtttggctgtgtccccaccgaaatctcaacttgaattgtatctcccagaattcccacgtattgtgggagggacctaagaggaggtagttgaatcatgagggccagtttttctcgtgctagtctcgtgatagtaagtctcacgagatctgatgggtttatcaggggtctccgcttttgcttctttctcattttctcttgctgtcgctgcttaagaagagcctttcgcctcccaccatgattgtgagaactcctcagccatgtggaactagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggtttgacctcttgcacgtagcttgcatgcctttggaactgggtctcttcagttga

SEQ ID NO: 6568 - DNA, 575 bp, Artificial Sequence
  Synthetic polypeptide
tgataggtttggctgtgtccccaccgaaatctcaacttgaattgtatctcccagaattcccacgtattgtgggagggacctaagaggaggtagttgaatcatgagggccagtttttctcgtgctagtctcgtgatagtaagtctcacgagatctgatgggtttatcaggggtctccgcttttgcttctttctcattttctcttgctgtcgctgcttaagaagagcctttcgcctcccaccatgattgtgagaactcctcagccatgtggaactagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttaggggtaagtcagaagtgcattcccccctgcctcacacatttctctggttcagccccaccacttgtctttttgctcctggtcattcagaacttgcagaagaatcaacagagtttctacttgatgaaatggtcctaa

SEQ ID NO: 6569 - DNA, 292 bp, Artificial Sequence
  Synthetic polypeptide
tggtgactttgaagagactgtcacctatcaccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6570 - DNA, 460 bp, Artificial Sequence
  Synthetic polypeptide
tggtgactttgaagagactgtcacctatcaccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6571 - DNA, 520 bp, Artificial Sequence
  Synthetic polypeptide
tggtgactttgaagagactgtcacctatcaccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6572 - DNA, 412 bp, Artificial Sequence
  Synthetic polypeptide
tggtgactttgaagagactgtcacctatcaccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6573 - DNA, 403 bp, Artificial Sequence
  Synthetic polypeptide
tggtgactttgaagagactgtcacctatcaccaagtgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttga

SEQ ID NO: 6574 - DNA, 445 bp, Artificial Sequence; identical to SEQ ID NO: 744
  Synthetic polypeptide

SEQ ID NO: 6575 - DNA, 59 bp, Artificial Sequence; identical to SEQ ID NO: 742
  Synthetic polypeptide

SEQ ID NO: 6576 - DNA, 123 bp, Artificial Sequence; identical to SEQ ID NO: 743
  Synthetic polypeptide

SEQ ID NO: 6577 - DNA, 854 bp, Artificial Sequence
  Synthetic polypeptide
gaagaacatggaaacactaggctgacttagtctcccagcctacatctttctcccatgctggacgctgcctgccctcaaacatcagactgcaagttcttcagcttttggactcttggacttacaccagtgatttgccaggagctctcaggccttcagcaacagactgaaggctgtgctgtcggcttccctacttttgaggttttgggactcagactggcttcctggctcttcagcttgcagatggcctattgtgggacttcaccttgtgatcatctcgcccgtgcttcgtgggggaatggagcccctggagtggttgtgcagaccagtgcaagcctacaacccgtgtgcggaggcgctcggtgcagcaggagcctcagaacggcggggcgccctgcccacccctggaagagagagctggctgcctggagtactccaccccgcagggccaggactgcgggcacacctatgttcctgcctttataactacctctgcattcaacaaggagagaacacgacaagctacgtctccacactggtctacacacacagaggatgctggatactgtatggagtttaagacagagtccttgactcctcactgtgctctggaaaactggcccttgactagatggatgcagtatctccgagagggatacacggtgtgtgtggattgtcagcctccagctatgaactctgtgagccttcgttgttctggagatggcctggactccgatggaaatcagactctccattggcaagcaattggtaatcctcggtgtcaaggaacttggaaaaaagttcggcgagtagaccagtgttcttgtccagctgttcacagttttatttttatatag

SEQ ID NO: 6578 - DNA, 558 bp, Artificial Sequence
  Synthetic polypeptide
tcacttaccaacttactcaccaactcacccagagcaactgcccatgctgcacactccagtgctgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaa

SEQ ID NO: 6579 - DNA, 639 bp, Artificial Sequence
  Synthetic polypeptide
tcacttaccaacttactcaccaactcacccagagcaactgcccatgctgcacactccagtgctgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcaggtgagcccagccctgctcccagcacgctcctgtcttctgtttgcagcggtctgtggagtcagcctcttcctcttccgtgagatcacccggaagttcaggctgaattctgaaggcaaacttgagcagacggtctccatggcaaccacgacacagccaatgactcagcatcttcacgtcacctacaagaaggtgaccccgtaa

SEQ ID NO: 6580 - DNA, 1775 bp, Artificial Sequence; identical to SEQ ID NO: 568
  Synthetic polypeptide

SEQ ID NO: 6581 - DNA, 575 bp, Artificial Sequence
  Synthetic polypeptide
ggccgggcgcagtggctcacacctgtaatcccagcactttggaacaccgagtcgcgcagaacacgagctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagatcaagggctgggaggccgtgagtatctaccagttccacggtcaggctactgctgaggactcagggaacagcagtgaccaggaaggcagggagttggagctggggcaggtgcccctttcggctcctccattgcccccacggccagatctgccccccaggaagcccagaaatgcccagccgaaagtgagactcctaaaggggaactcccctccagctgcgctgggaccccaggaccctgccccggcctga

SEQ ID NO: 6582 - DNA, 119 bp, Artificial Sequence
  Synthetic polypeptide
ggctgggcaccgtggctcatggctgtaatccccagcactgtgggaggccaaggagggaggatcacctgaggtcaggagttcgagaccagcctggccaacatggcgagaccaggcgctga

SEQ ID NO: 6583 - DNA, 333 bp, Artificial Sequence
  Synthetic polypeptide
ggccgggcgtggtggctcacacatgtaatcccagcactttgcgaggctgaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctga

SEQ ID NO: 6584 - DNA, 100 bp, Artificial Sequence
  Synthetic polypeptide
tagaggacagcaagtaaagggcccaggagacaccagcgggggctgccgctgcagggtaaatgggattccttgccacccaagctgtcagaactgccactga

SEQ ID NO: 6585 - DNA, 174 bp, Artificial Sequence
  Synthetic polypeptide
ccatcaccaagcggtgagactatcacctatcgccaagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6586 - DNA, 342 bp, Artificial Sequence
  Synthetic polypeptide
ccatcaccaagcggtgagactatcacctatcgccaagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6587 - DNA, 402 bp, Artificial Sequence
  Synthetic polypeptide
ccatcaccaagcggtgagactatcacctatcgccaagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6588 - DNA, 294 bp, Artificial Sequence
  Synthetic polypeptide
ccatcaccaagcggtgagactatcacctatcgccaagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6589 - DNA, 285 bp, Artificial Sequence
  Synthetic polypeptide
ccatcaccaagcggtgagactatcacctatcgccaagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttga

SEQ ID NO: 6590 - DNA, 540 bp, Artificial Sequence
  Synthetic polypeptide
tgtttctcctctagagtttaagttgcttgagggaggaatctgttcatcaccgtgtctctaacaccagcggagtgactgcacgcaccagctggtgctcaagaccgaatcggctgggcttttggcctaggattagaaaggctagccatgatcctctacgacatccctgatatccgtctcttctggtgtgaggacgagcgcttcctgaagcagttctgtgtatccaacattaatcagaaggtgaagtttcagcctcttagcaaatatccggctgtgatcaatgatatttcattctggttgccctctgagaattacgcagaaaatgatttctatgacttagtccgaacaattggaggagacctggtggaaaaggttgatctcatagacaagtttgtacatccaaagacgcacaagaccagccactgctaccgcatcacgtaccgccacatggaacggactctgtcccagagagaggtcaggcacatccaccaggccttgcaggaggctgcagtccagctgttgggtgtggagggcaggttctga

SEQ ID NO: 6591 - DNA, 557 bp, Artificial Sequence
  Synthetic polypeptide
ctgggcacagtggctcacgcctgtaatcccagcactttgggaggccgaggcgggtggatcacgagatcaggagtttgagaccagcctgaccaacatggtgaaaccctgtctcttctaaagatacaaaaattagccgggcatggtggcacgcacctgtagtcccagctacttgtgaggctgaggcaggagaatcgcttgaatccgggaggcggaggttgcagtgagccgagatcatgccacttcactccagcctgagtgacagaaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctga

SEQ ID NO: 6592 - DNA, 561 bp, Artificial Sequence
  Synthetic polypeptide
cagggatgtcaatctgttttcatctcagatgccacctctaaccagttgatactgactctctggaatgctgtgttgacaggaatcctgagcccagagtcacttgccgcaggaaacggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactga

SEQ ID NO: 6593 - DNA, 196 bp, Artificial Sequence
  Synthetic polypeptide
cagggatgtcaatctgttttcatctcagatgccacctctaaccagttgatactgactctctggaatgctgtgttgacaggaatcctgagcccagagtcacttgccgcaggaaacggtatttctcaaagagactacacacaatactatgatcatatttctaaacaaaaggaagaaattcgcagatgcatacaagact

SEQ ID NO: 6594 - DNA, 423 bp, Artificial Sequence
  Synthetic polypeptide
cagggatgtcaatctgttttcatctcagatgccacctctaaccagttgatactgactctctggaatgctgtgttgacaggaatcctgagcccagagtcacttgccgcaggaaacggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcagaagagaaatcagcaggaggacgactga

SEQ ID NO: 6595 - DNA, 268 bp, Artificial Sequence
  Synthetic polypeptide
ccatcaccaagcgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6596 - DNA, 436 bp, Artificial Sequence
  Synthetic polypeptide
ccatcaccaagcgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6597 - DNA, 496 bp, Artificial Sequence
  Synthetic polypeptide
ccatcaccaagcgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6598 - DNA, 388 bp, Artificial Sequence
  Synthetic polypeptide
ccatcaccaagcgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6599 - DNA, 379 bp, Artificial Sequence
  Synthetic polypeptide
ccatcaccaagcgatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttga

SEQ ID NO: 6600 - DNA, 970 bp, Artificial Sequence; identical to SEQ ID NO: 711
  Synthetic polypeptide

SEQ ID NO: 6601 - DNA, 476 bp, Artificial Sequence
  Synthetic polypeptide
tgtctcacgcctgtatcccagcactttgagaggccaagggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgaaccaccaaactgttttccacagaggctgcatcaattgacattcccactagcaatggatgagggttccaatttttccagatgctcaccaacacttgttaattttggttttgttttcattatggccattctggtgggtgtaaagtag

SEQ ID NO: 6602 - DNA, 461 bp, Artificial Sequence
  Synthetic polypeptide
tgtctcacgcctgtatcccagcactttgagaggccaagggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgccaactacacagacccccagagcaaactgcggttcagcaccattgaagagttttcctacattcggaggctgccctctgacgtcgtcaccggctacctggccctgaggaaggccacgagcatcgttccctga

SEQ ID NO: 6603 - DNA, 361 bp, Artificial Sequence
  Synthetic polypeptide
tgtctcacgcctgtatcccagcactttgagaggccaagggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgccaactacacagacccccagagcaaactgcg

SEQ ID NO: 6604 - DNA, 535 bp, Artificial Sequence
  Synthetic polypeptide
tggtagattacgcagccataaaaaagaatgaagtcatgtcttttgtagcaacatggatgctgctggaagtgattatcctacatgaattaatgcagaaacagaaaatcacataccacatgttctcacttataaattggcagcgatgttcctgggaatggatttaccaggactgaatcttcctgattcatggaaaacctatgcaatgaccggattcgtagcctggcatgttgggactgaggttgttctggagttgaaatattggatgatgacagaattcagatccttcagtcatttactgcagtggaaacagagggtcatgcttttaaaaaggcagtgttggcaatttatgtctgtgggaatgttacttttctcatcatatttttatctgcaatcaaccatctatgagcaagcaaagaccttggcttttgcaggccaagtgataattatcatcaaaccaaagaaacttgaagcctgtcctgactgcctggagcatatttgtgaattctcacttggaagactggggtcatgtctgtag

SEQ ID NO: 6605 - DNA, 433 bp, Artificial Sequence
  Synthetic polypeptide
tggtagattacgcagccataaaaaagaatgaagtcatgtcttttgtagcaacatggatgctgctggaagtgattatcctacatgaattaatgcagaaacagaaaatcacataccacatgttctcacttataaattggcagcgatgttcctgggaatggatttaccaggactgaatcttcctgattcatggaaaacctatgcaatgaccggattcgtagcctggcatgttgggactgaggttgttctggaggtacatgcttatcggctctctcgcaaagttgaaatattggatgatgacagaattcagatccttcagtcatttactgcagtggaaacagagggtcatgcttttaaaaaggcagtgttggcaatttatgtctgtgggaatgttacttttctcatcatatttttatctgcaatcaaccatctatga

SEQ ID NO: 6606 - DNA, 1688 bp, Artificial Sequence
  Synthetic polypeptide
tcgccgtcctcagcaagacgtggcaaacaagatgcagtgaatctttggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctga

SEQ ID NO: 6607 - DNA, 893 bp, Artificial Sequence
  Synthetic polypeptide
tcgccgtcctcagcaagacgtggcaaacaagatgcagtgaatctttggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctga

SEQ ID NO: 6608 - DNA, 1124 bp, Artificial Sequence
  Synthetic polypeptide
tcgccgtcctcagcaagacgtggcaaacaagatgcagtgaatctttggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagaacctga

SEQ ID NO: 6609 - DNA, 661 bp, Artificial Sequence
  Synthetic polypeptide
ccatcaccaagcggtgagactatcacctatcgccaagtggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6610 - DNA, 829 bp, Artificial Sequence
  Synthetic polypeptide
ccatcaccaagcggtgagactatcacctatcgccaagtggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6611 - DNA, 889 bp, Artificial Sequence
  Synthetic polypeptide
ccatcaccaagcggtgagactatcacctatcgccaagtggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6612 - DNA, 1305 bp, Artificial Sequence
  Synthetic polypeptide
catttacaaaatattcaaaatatgcaaaacggtactataatatttataaatacatacatatataacaagcagaaagataggaataggaataataaacactaaattcaggcaagtggccgtcttggggacgcaaaaggaaatgtgttcaggaatgaatacctggaagcctcgctatctggaatatttttcttaagctgtgttgagggaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaa

SEQ ID NO: 6613 - DNA, 1854 bp, Artificial Sequence
  Synthetic polypeptide
ctctccctctccccctccccctccccctctccctctccccacggtctccctctccctctctttccagggtctccctctgatgcccagccgaagctggactgtactgctgccatctcggctcactgcaacctccccgcctgattctcctgcctcagcctgcagagtgcctgccattgcaggcacgcgccgccacgcctgactggttttcgtatttttttggtggagatggggtttcgctgtgttggccgggctagtctccagctcctaaccgcgagtgatccgccagcctcggcctccggaggtgccgggattgcagacggtgtctggttcaatcagtgctcaatggtgcccaggctggaatgcagtggcgtgatctcggctcgctacaacctccacctcccagccacctgccttggcctcccaaagtgccgagagtgcagcctctgcccggccgccaccccgtctgggaagtgaggagcgtctctgcctggccgcctatcgtctgggacgtgaggagcccctctgcgtggctgcccagtctggaaagtgaggagcgtctctgcccggtcgccatcccatctaggaagtgaggagcgcctcttcccggccgccatcccatctaggaagtgaggagcatctctgcctggccgcccttcttctgagatgtggggagcgcctttgccccaccgccctgtctgggatgtgaggagcgcctctgccaggccgcgaccccgtctgggaggaaccagtagatcctctaaaggaagaagccttattggtaaggttgatggcacatcccacgtcactggaaaaggagttacagttgaaacagtcttttctgtggatgagttttctgcatctgtcctcactggaaaactgaccactgtcttccttccaattgtctacacaattgtgtttgtggtgggtttgccaagtaacggcatggccctgtgggtctttcttttccgaactaagaagaagcaccctgctgtgatttacatggccaatctggccttggctgacctcctctctgtcatctggttccccttgaagattgcctatcacatacatggcaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattggcatctccctggcaatatggctgctgattctgctggtcaccattcctttgtatgtcgtgaagcagaccatcttcattcctgccctgaacatcacgacctgtcatgatgttttgcctgagcagctcttggtgggagacatgttcaattacttcctctctctggccattggggtctttctgttcccagccttcctcacagcctctgcctatgtgctgatgatcagaatgctgcgatcttctgccatggatgaaaactcagagaagaaaaggaagagggccatcaaactcattgtcactgtcctggccatgtacctgatctgcttcactcctagtaaccttctgcttgtggtgcattattttctgattaagagccagggccagagccatgtctatgccctgtacattgtagccctctgcctctctacccttaacagctgcatcgacccctttgtctattactttgtttcacatgatttcagggatcatgcaaagaacgctctcctttgccgaagtgtccgcactgtaaagcagatgcaagtatccctcacctcaaagaaacactccaggaaatccagctcttactcttcaagttcaaccactgttaagacctcctattga

SEQ ID NO: 6614 - DNA, 873 bp, Artificial Sequence
  Synthetic polypeptide
gccgggcgcggtggctcacgcctgtcatcccagcactctgggaggccgaggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctga

SEQ ID NO: 6615 - DNA, 207 bp, Artificial Sequence
  Synthetic polypeptide
gccgggcgcggtggctcacgcctgtcatcccagcactctgggaggccgaggttggtgtcttgttccgctaccactcagcagtgggctgatctctccttggcccttgaagtcaaccagtccctgacagcagctgtgctttcgatctggggccacagacgagcaatggtcatgcctgacttggctgtatggaacctctcgctgatgtga

SEQ ID NO: 6616 - DNA, 763 bp, Artificial Sequence; identical to SEQ ID NO: 606
  Synthetic polypeptide

SEQ ID NO: 6617 - DNA, 1084 bp, Artificial Sequence; identical to SEQ ID NO: 580
  Synthetic polypeptide

SEQ ID NO: 6618 - DNA, 2448 bp, Artificial Sequence
  Synthetic polypeptide
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggtgaggagcgtctctgcccggccgccccgtctcagaagtgaggagaccctccgcccggcagccgccccgtatgagaagtgaggagcctctccacccggcagccgccccgtctgggaagtgaggagcatctccgcccggcagccaccccgtccgggagggaggtggggggtcagccccccgcccggccagccgccccgtccgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaa

SEQ ID NO: 6619 - DNA, 1543 bp, Artificial Sequence
  Synthetic polypeptide
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggtgaggagcgtctctgcccggccgccccgtctcagaagtgaggagaccctccgcccggcagccgccccgtatgagaagtgaggagcctctccacccggcagccgccccgtctgggaagtgaggagcatctccgcccggcagccaccccgtccgggagggaggtggggggtcagccccccgcccggccagccgccccgtccgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaacccca

SEQ ID NO: 6620 - DNA, 1468 bp, Artificial Sequence
  Synthetic polypeptide
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggtgaggagcgtctctgcccggccgccccgtctcagaagtgaggagaccctccgcccggcagccgccccgtatgagaagtgaggagcctctccacccggcagccgccccgtctgggaagtgaggagcatctccgcccggcagccaccccgtccgggagggaggtggggggtcagccccccgcccggccagccgccccgtccgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctga

SEQ ID NO: 6621 - DNA, 2672 bp, Artificial Sequence
  Synthetic polypeptide
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggtgaggagcgtctctgcccggccgccccgtctcagaagtgaggagaccctccgcccggcagccgccccgtatgagaagtgaggagcctctccacccggcagccgccccgtctgggaagtgaggagcatctccgcccggcagccaccccgtccgggagggaggtggggggtcagccccccgcccggccagccgccccgtccgggaggtgaggggcgcctctgcccggccgcccctactgggaagtgaggagcccctctgcccggccagccgccccgtccgggagggaggtgggggggtcaggccccgcccggccagccgccccgtccgggagggaggtgggggggtcagccccccgtctggccagccgcccggtccgggagggaggtgggggggtcagccccccgcccggccagccgccccgtccgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaa

SEQ ID NO: 6622 - DNA, 1767 bp, Artificial Sequence
  Synthetic polypeptide
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggtgaggagcgtctctgcccggccgccccgtctcagaagtgaggagaccctccgcccggcagccgccccgtatgagaagtgaggagcctctccacccggcagccgccccgtctgggaagtgaggagcatctccgcccggcagccaccccgtccgggagggaggtggggggtcagccccccgcccggccagccgccccgtccgggaggtgaggggcgcctctgcccggccgcccctactgggaagtgaggagcccctctgcccggccagccgccccgtccgggagggaggtgggggggtcaggccccgcccggccagccgccccgtccgggagggaggtgggggggtcagccccccgtctggccagccgcccggtccgggagggaggtgggggggtcagccccccgcccggccagccgccccgtccgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaacccca

SEQ ID NO: 6623 - DNA, 1692 bp, Artificial Sequence
  Synthetic polypeptide
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggtgaggagcgtctctgcccggccgccccgtctcagaagtgaggagaccctccgcccggcagccgccccgtatgagaagtgaggagcctctccacccggcagccgccccgtctgggaagtgaggagcatctccgcccggcagccaccccgtccgggagggaggtggggggtcagccccccgcccggccagccgccccgtccgggaggtgaggggcgcctctgcccggccgcccctactgggaagtgaggagcccctctgcccggccagccgccccgtccgggagggaggtgggggggtcaggccccgcccggccagccgccccgtccgggagggaggtgggggggtcagccccccgtctggccagccgcccggtccgggagggaggtgggggggtcagccccccgcccggccagccgccccgtccgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctga

SEQ ID NO: 6624 - DNA, 507 bp, Artificial Sequence; identical to SEQ ID NO: 881
  Synthetic polypeptide

SEQ ID NO: 6625 - DNA, 459 bp, Artificial Sequence
  Synthetic polypeptide
caggggttcccaaccccctggtatcaggtctgtggcctgttaagaaccaggtcacacagcaggaggtgaacagtgggtgagccagcaaagcttcatctgtatttacagccacaatctgagctctgccttccgtcagatcaacacagacgttcgattctcataggaactcaaaccctattacaaactgcacatgcgaggaatctaggctacgtgctccttatgaaaatctaatgcctgatgatctgtcactgtctcccatcacccccagatgtgaccatctagttgcaggaaaacaagctcagggctgtcactgattccacattgtgagaaggatgccgcatagagaatgtactgaagaatatcaaatgcagaaagtatgctttcaacatgctacagctgatggctttccccaagtactacagacctccagaggggacttatggaaaagctgacacctaa

SEQ ID NO: 6626 - DNA, 829 bp, Artificial Sequence
  Synthetic polypeptide
gagggaggagccaagatggccgaataggaacagctccggtctacagctcccaggatgagcgacgcagaagacgggtgatttctgcatttccatctgaggtaccgggttcatctcactagggagtgccagacagtgggcgcaggctggaagtgatggagagagtattggaaactgtcccttttgccaacgccttttcatgatcctctggcttaaaggagttaaatttaatgtgacaactgttgacatgaccagaaagcctgaagaactaaaggacttagccccaggtaccaatcctccgttcctggtgtataacaaggagttgaaaacagacttcattaaaattgaggagtttttagaacaaaccctggctcctccaaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaagttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttag

SEQ ID NO: 6627 - DNA, 484 bp, Artificial Sequence
  Synthetic polypeptide
gagggaggagccaagatggccgaataggaacagctccggtctacagctcccaggatgagcgacgcagaagacgggtgatttctgcatttccatctgaggtaccgggttcatctcactagggagtgccagacagtgggcgcaggctggaagtgatggagagagtattggaaactgtcccttttgccaacgccttttcatgatcctctggcttaaaggagttaaatttaatgtgacaactgttgacatgaccaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggat

SEQ ID NO: 6628 - DNA, 238 bp, Artificial Sequence
  Synthetic polypeptide
gaacatgttccctctgagatcacagatgagacgttcttgctatcaccacttgcatttcacattggactgaacgttctatccagtgcaaatcctagccaggcaagagaaagttaaacccttctcaggcaccaccccatccaggaaaccactccccaagaggaagaacacgtggaacttcctgaaatgcgcctacatggtgatgacctacctcttcgtatcctacaacaaaggggactgg

SEQ ID NO: 6629 - DNA, 2504 bp, Artificial Sequence
  Synthetic polypeptide
gtgagaggtcacagcgtgctggcagtcctcacagccctcgctcgctctcggcgcctcctctgcctgggctcccactttggcggcacttgaggagctcttcagcccaccgctgcactgtaggagcccctttctgggctggccaaggtcggagccggctccctcagcttgcagggaggtgtggagggagaggcgtgagccggaaccagggctgcgcgcagcgcttgcgggccagctagagttcccggtgagcatgggcttggcgggccccgcactcggagcagccggccggccctgccggccccgggcaatgaggggcttagcacccagccagcagctgcggagggggttctaggtcccccagtagtgccggcctaccggcactgcgctcgatttctcgctgggccttagctgccttcccctggggcagggctcgggacctgcagcccgccatgcctgagcctcccaccccctccgtgggctcctgtgtggccccagcctccttgacgagcgccactccctgctccacggcgcccagtcccatcgaccacccaagggctgaggagtgcaggcgcacagcgcaggactggcaggcagctccagtcctgcaggcagctccacccgcagccccggtgcgggatccactgggtgaagccagctgggctcctgagtctggtggagccttggagaacctttatgtgtagctcagggattgtaaatacaccaatcggcactctgtatctagctcaaggtttgtaaacacaccaatcagcaccctgtgtctagctcagggtttctgagtgcaccaatcgacactctgtatctcgctgctctggtgggggcttggagaacctttgtgtggatactctgtatctaactaatctgatggggacgtggagaacctttgtgtctagctcagggattgtaaacgcaccaatcagcgccctgacaaaacagaccacttggctctaccaatcagcaggatgtgggtggggccagataagagaataaaagcaggctgccagagcaagcagtggcaacacgctcgggtccccttccacactgtggaagctttgttctttcgctctttgcaataaatcttgctactgctcactctttgggtccacgctgcttttatgagctgtgacactcaccacgaaggtctgcagcttcactcctgaagccagtgagaccacgagcccaccgggaggaacgaacaactccggacgcgctgccttaagagctgtaacactcactgtgaaggtctgcagcttcactcctgagccagcgagaccacgaacgcaccagaaggaagaaattccggacacatccgaacatcagaaggaacaaactccagacgtgctaccttaagagctgtaacactcaccgcgagggtccgcggcttcattcttgaagtgacttctgggggaacagaaagcatactgatggcctgcaaagcatatcgggatctggcctttgagaaggggatcaaaactccagaaattgtggctccccaaagtgcccatgctgcatttaacaaagcagccagttactttgggatgaagattgtgcgggtcccattgacgaagatgatggaggtggatgtgcgggcaatgagaagagctatctccaggaacactgccatgctcgtctgttctaccccacagtttcctcatggtgtaatagatcctgtccctgaagtggccaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagcctgttgggctgccttgatgcacttcggtgagaacggctatgttgaagctaccaaacagatcatcaaaactgctcgcttcctcaagtcagaactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccagtattcatttctgcatcacattactacacgcccggaaacgagtagctatacaattcctaaaggacattcgagaatctgtcactcaaatcatgaagaatcctaaagcgaagaccacaggaatgggtgccatctatggcatggcccagacaactgttgacaggaatatggttgcagaattgtcctcagtcttcttggacagcttgtacagcaccgacactgtcacccagggcagccagatgaatggttctccaaaaccccactga

SEQ ID NO: 6630 - DNA, 411 bp, Artificial Sequence
  Synthetic polypeptide
tggtagtttaaaaatggccacagattcttcatagctcctcccatcaagaggtggtctgatttttcaccctttgtattcaggttggcctttgtcatttgttttgaccaatagaatatagcaaaaaatgacatgtgatttctgaacctaggcctcaagaagcattgcagcttcagctcttaccttcttagatccttgagtccaccaagtgaagaagactaagctctcctcctgacggaagaaacaccaagtagagagaggcctagctatcccagcttaggccctagtgaggccatcctggactacccagctcagaataaccaccctaccaatccacagaaaagtggatctccttacgtagcagccaaaataaatgaagcaaaagacttgctagaaacaaccaccaaacattga

SEQ ID NO: 6631 - DNA, 1267 bp, Artificial Sequence
  Synthetic polypeptide
tttcccccagagccatttgtttaccttcaatgattgtgaaagtccccttcccagggaggacttgtttacattccaggttctctcctctctctggaagggaggagggccacatatgtcaaccattctatataagctctgagtctcataatttcagagttcttctctgtagcgcagaccccactgcatatgcaggtgaattgaacatctgaccttcatcacattgtccttgggacatggaaactgactcaaggcatggtttataaggcgagagcattttgggggggccatggtgtggacattggacatggatgacgtcaggggcacgttctgtggcactggccctttcccccttgtctacgtattgaatgatatcctggtgcgggctgagttcagttcaacttctttaccacaattttggctgtcatctgctgtgaattcttcaagcactgaccctgaaaggctggctgtgaccacggcatggaccactgatagtaagattttgcccccaggaggagaggctggggtcactgagatccacggaaagtgtgaaaatatgactataacccctagaggtacaactgtgacccctacaaaggaaactgtatcccttggaaagcacactgtagctctaggagagaagactgagatcactggggcaatgaccatgacttctgtgggtcatcagtccatgacccctggagagaaggccctgacccctgtgggtcatcaatctgtgaccactggacagaagaccctgacctctgtgggttatcagtctgtgacccctggggaaaagaccctgacccctgtgggtcatcagtctgtgacccctgtgagtcatcagtctgtgagccctggaggaacgactatgacccctgtccattttcagactgagacccttagacagaatacagtggcccctagaaggaaggctgtggcccgtgaaaaggtgactgtcccctccagaaacatatcagtcacccctgaagggcagactatgcctttaagaggggagaatttgacttctgaggtgggcactcaccccaggatgggtaacttgggtcttcagatggaagctgaaaacaggatgatgctgtcctccagccccgtcatccagctcccggaacaaactcctctagcttttgacaaccgctttgttcccatctatggaaaccattcctctgtcaactcagtaacccctcaaacaagtcctctttctctaaaaaaagaaatcccagaaaactctgctgtggatgaagaagcctaa

SEQ ID NO: 6632 - DNA, 263 bp, Artificial Sequence
  Synthetic polypeptide
tttcccccagagccatttgtttaccttcaatgattgtgaaagtccccttcccagggaggacttgtttacattccaggttctctcctctctctggaagggaggagggccacatatgtcaaccattctatataagctctgagtctcataatttcagagttcttctctgtagcgcagaccccactgcatatgcaggtgaattgaacatctgaccttcatcacattgtccttgggacatggaaactgactcaaggcatggtttataa

SEQ ID NO: 6633 - DNA, 493 bp, Artificial Sequence
  Synthetic polypeptide
tgggaggctgaggcaggtggagcacttgagatcaggagtttcagaccagcctggccaacatggcaaaaccccctctctaccataaaaatagaaacattagctgggcatggtggcgtgtgcccataatctcagctactcaggaggctgaaacaggaggatcgcttgagcccatgaggttgcactgagccaagatcatgccattgcactcagcctaggcaacagagctaaagaattacctccaaagccattgtcaagaccacagcagtcatctgcaccagtccagctgaactctggctctcaaagcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaa

SEQ ID NO: 6634 - DNA, 550 bp, Artificial Sequence
  Synthetic polypeptide
tgggaggctgaggcaggtggagcacttgagatcaggagtttcagaccagcctggccaacatggcaaaaccccctctctaccataaaaatagaaacattagctgggcatggtggcgtgtgcccataatctcagctactcaggaggctgaaacaggaggatcgcttgagcccatgaggttgcactgagccaagatcatgccattgcactcagcctaggcaacagagctaaagaattacctccaaagccattgtcaagaccacagcagtcatctgcaccagtccagctgaactctggctctcaaagtaacagaaatgaatataagctctatcctggactttccagctatcatgagagagttggcaatttgaatcaacccatagaagtgacagcgctgtattcatttgaaggacagcagcctggggatttgaattttcaagctggagacagaatcacagttatatcaaaaacagattcacattttgattggtgggaaggaaaacttcgaggtcaaactggcatttttccagccaactacgtaaccatgaattaa

SEQ ID NO: 6635 - DNA, 346 bp, Artificial Sequence
  Synthetic polypeptide
tgggaggctgaggcaggtggagcacttgagatcaggagtttcagaccagcctggccaacatggcaaaaccccctctctaccataaaaatagaaacattagctgggcatggtggcgtgtgcccataatctcagctactcaggaggctgaaacaggaggatcgcttgagcccatgaggttgcactgagccaagatcatgccattgcactcagcctaggcaacagagctaaagaattacctccaaagccattgtcaagaccacagcagtcatctgcaccagtccagctgaactctggctctcaaagtaaatatttttgttgcaattcaaatacagttgtaattaagtaa

SEQ ID NO: 6636 - DNA, 375 bp, Artificial Sequence; identical to SEQ ID NO: 860
  Synthetic polypeptide

SEQ ID NO: 6637 - DNA, 255 bp, Artificial Sequence; identical to SEQ ID NO: 862
  Synthetic polypeptide

SEQ ID NO: 6638 - DNA, 1052 bp, Artificial Sequence; identical to SEQ ID NO: 447
  Synthetic polypeptide

SEQ ID NO: 6639 - DNA, 1118 bp, Artificial Sequence; identical to SEQ ID NO: 448
  Synthetic polypeptide

SEQ ID NO: 6640 - DNA, 785 bp, Artificial Sequence
  Synthetic polypeptide
attatatgtatataagttttcatccacagttcctggcctataactcccatagcccttttacagtcatctgttataatgttgggacactttaggccttagaaacaggcctcaggaagcagaatttctctctctctgacctctcctgccctcctttcacctgcccaaggcagggttctaatctaattgtgggtcataagaccctcattccagagagggccctgccccataccctggagggaaggaatgctgcacagaaaggccgaaaagaatctgagcagacaggccctgatggattccaccctcggtctgttagtattaaatcataccctttttgcccaatcacattttgacatggttgtccatgctttagtcatgcttatccaacgagtgtataaaaggcccaagaagacaaggttcagagagcttccggatagctgaacgcatggaggctgacaggacagtgaaggagaactcatccacgcgctgggcgagtggtgcaccccaactccacaggaacggaagctcctccagatcttgccttgtgttatctttccatctggctatttatttgcatcctttttaaatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctag

SEQ ID NO: 6641 - DNA, 974 bp, Artificial Sequence
  Synthetic polypeptide
attatatgtatataagttttcatccacagttcctggcctataactcccatagcccttttacagtcatctgttataatgttgggacactttaggccttagaaacaggcctcaggaagcagaatttctctctctctgacctctcctgccctcctttcacctgcccaaggcagggttctaatctaattgtgggtcataagaccctcattccagagagggccctgccccataccctggagggaaggaatgctgcacagaaaggccgaaaagaatctgagcagacaggccctgatggattccaccctcggtctgttagtattaaatcataccctttttgcccaatcacattttgacatggttgtccatgctttagtcatgcttatccaacgagtgtataaaaggcccaagaagacaaggttcagagagcttccggatagctgaacgcatggaggctgacaggacagtgaaggagaactcatccacgcgctgggcgagtggtgcaccccaactccacaggaacggaagctcctccagatcttgccttgtgttatctttccatctggctatttatttgcatcctttttaaatattcctcggacaccacaccctgctgctttgcctacattgcccgcccactgccccgtgcccacatcaaggagtatttctacaccagtggcaagtgctccaacccagcagtcgtccacaggtcaaggatgccaaagagagagggacagcaagtctggcaggatttcctgtatgactcccggctgaacaagggcaagctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttga

SEQ ID NO: 6642 - DNA, 785 bp, Artificial Sequence
  Synthetic polypeptide
gagggaggagccaagatggccgaataggaacagctccggtctacagctcccaggatgagcgacgcagaagacgggtgatttctgcatttccatctgaggctggaagtgatggagagagtattggaaactgtcccttttgccaacgccttttcatgatcctctggcttaaaggagttaaatttaatgtgacaactgttgacatgaccagaaagcctgaagaactaaaggacttagccccaggtaccaatcctccgttcctggtgtataacaaggagttgaaaacagacttcattaaaattgaggagtttttagaacaaaccctggctcctccaaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaagttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttag

SEQ ID NO: 6643 - DNA, 440 bp, Artificial Sequence
  Synthetic polypeptide
gagggaggagccaagatggccgaataggaacagctccggtctacagctcccaggatgagcgacgcagaagacgggtgatttctgcatttccatctgaggctggaagtgatggagagagtattggaaactgtcccttttgccaacgccttttcatgatcctctggcttaaaggagttaaatttaatgtgacaactgttgacatgaccaggtaccctcacctgagtcccaagtacaaggagtcttttgatgtgggctgtaacctctttgccaagttttctgcatacattaagaatacacaaaaggaggcaaataagaattttgaaaaatctctgctcaaagaattcaagcgtctggatgactacttaaacaccccacttctggatgaaattgatccagacagtgctgaggaacccccagtttccagaagactattcttggat

SEQ ID NO: 6644 - DNA, 1759 bp, Artificial Sequence
  Synthetic polypeptide
tctgaccctgcaggcctcccagccctctcccttggcacctgtctctgctctggtcacaccttgctctctccagttctgaaggcgccctgtgcctgtgtgcaccacattctcagtccttcacatctgtctttgcacgaaattgccggccctgcactggagcccagcccctcacctaccttgactactcctggtgacaacctcccagctggcagtgccgcccaccacgtgcactgtgctgctgctggcagagagcgagggggagcgggaacgctggctgcaggtgctgggtgagctgcagcggctgctgctggacgcgcggccaagaccccggcccgtgtacacactcaaggaggcttacgacaacgggctgccgctgctgcctcacacgctctgcgctgccatcctcgaccaggatcgacttgcgcttggcaccgaggaggggctctttgtcatccatctgcgcagcaacgacatcttccaggtgggggagtgccggcgcgtgcagcagctgaccttgagccccagtgcaggcctgctggtcgtgctgtgtggccgcggccccagcgtgcgtctctttgccctggcggagctggagaacatagaggtagcaggtgccaagatccccgagtctcgaggctgccaggtgctggcagctggaagcatcctgcaggcccgcaccccggtgctctgtgtagccgtcaagcgccaggtgctctgctaccagctgggcccgggccctgggccctggcagcgccgcatccgtgagctgcaggcacctgccactgtgcagagcctggggctgctgggcgaccggctatgtgtgggcgccgccggtggctttgcactctacccgctgctcaacgaggctgcgccgttggcgctgggggccggtttggtgcctgaggagctgccaccatcccgcgggggcctgggtgaggcactgggtgccgtggagcttagcctcagcgagttcctgctactcttcaccactgctggcatctacgtggatggcgcaggccgcaagtctcgtggccacgagctgttgtggccagcagcgcccatgggctgggggtatgcggccccctacctgacagtgttcagcgagaactccatcgatgtgtttgacgtgaggagggcagaatgggtgcagaccgtgccgctcaagaaggtgcggcccctcaatccagagggctccctgttcctctacggcaccgagaaggtccgcctgacctacctcaggaaccagctggcagagaaggacgagttcgacatcccggacctcaccgacaacagccggcgccagctgttccgcaccaagagcaagcgccgcttctttttccgcgtgtcggaggagcagcagaagcagcagcgcagggagatgctgaaggacccttttgtgcgctccaagctcatctcgccgcctaccaacttcaaccacctagtacacgtgggccctgccaacgggcggcccggcgccagggacaagtccccggctcccgaagagaagggccgagttgcccgcggctccggcccacagcggccccacagcttctccgaggcgttgcggcgcccagcctccatgggcagcgaaggcctcggtggagacgcagaccccatgaagaggaaaccctggacatccctgtccagcgagtctgtgtcctgcccccagggatcgctgagccctgcaacctccctaatgcaggtctcagaacggccccgaagcctccccctatcccctgaattggagagctctccttga

SEQ ID NO: 6645 - DNA, 308 bp, Artificial Sequence
  Synthetic polypeptide
taggtgtcagccactatgcccagcccgccctctgactttccatctcccaccccacttatttttcttcaaaccacttatctctgcctgaccctgcacgacagatcgtgtttgctgactggcacagcctccaggttggcgggctcatctgcgctggggttctgtgcgccatgggcatcatcatcgtcatgagtgagtggaggagctcgggggagcaggcgggccggggctggggctcccctcccctgaccactcagctctccccaacaggtgcaaaatgcaaatgcaagtttggccagaagtccgggtaa

SEQ ID NO: 6646 - DNA, 281 bp, Artificial Sequence
  Synthetic polypeptide
taggtgtcagccactatgcccagcccgccctctgactttccatctcccaccccacttatttttcttcaaaccacttatctctgcctgaccctgcacgacagatcgtgtttgctgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctga

SEQ ID NO: 6647 - DNA, 359 bp, Artificial Sequence
  Synthetic polypeptide
taggtgtcagccactatgcccagcccgccctctgactttccatctcccaccccacttatttttcttcaaaccacttatctctgcctgaccctgcacgacagatcgtgtttgctgactggcacagcctccaggttggcgggctcatctgcgctggggttctgtgcgccatgggcatcatcatcgtcatgagtgagtggaggagctcgggggagcaggcgggccggggctggggctcccctcccctgaccactcagctctccccaacaggtgcaaaatgcaaatgcaagtttggccagaagtccggtcaccatccaggggagactccacctctcatcaccccaggctcagcccaaagctga

SEQ ID NO: 6648 - DNA, 230 bp, Artificial Sequence
  Synthetic polypeptide
taggtgtcagccactatgcccagcccgccctctgactttccatctcccaccccacttatttttcttcaaaccacttatctctgcctgaccctgcacgacagatcgtgtttgctgactggcacagcctccaggttggcgggctcatctgcgctggggttctgtgcgccatgggcatcatcatcgtcatgagtgcaaaatgcaaatgcaagtttggccagaagtccgggtaa

SEQ ID NO: 6649 - DNA, 456 bp, Artificial Sequence
  Synthetic polypeptide
tcctaagacatggacctgaccaccccactctgctgctgtgtactcttcaatgcctccccccaaaatttttgtgttaaaatcatagcctttgatgagctgcggaccgacttcaagaaccccatcgaccaggggaaccctgcgcgggcacgcgagcgtttaaaaaacatcgaacgcatctgctgcctcctgaggaagctggtggtcccagaatactccatccacggcctcttctgtctgatgtttctgtgtgcagcagagtgggtgaccctgggcctcaacatccccctcctcttctaccacctctggaggtacttccaccgtcctgcagatggctctgaggtcatgtatgatgcggtctccatcatgaatgctgacattctcaactactgccagaaggagtcctggtgcaaacttgccttctacctgctctccttcttctattacctgtacaggtga

SEQ ID NO: 6650 - DNA, 480 bp, Artificial Sequence
  Synthetic polypeptide
tcctaagacatggacctgaccaccccactctgctgctgtgtactcttcaatgcctccccccaaaatttttgtgttaaaatcatagcctttgatgagctgcggaccgacttcaagaaccccatcgaccaggggaaccctgcgcgggcacgcgagcgtttaaaaaacatcgaacgcatctgctgcctcctgaggaagctggtggtcccagaatactccatccacggcctcttctgtctgatgtttctgtgtgcagcagagtgggtgaccctgggcctcaacatccccctcctcttctaccacctctggaggtacttccaccgtcctgcagatggctctgaggtcatgtatgatgcggtctccatcatgaatgctgacattctcaactactgccagaaggagtcctggtgcaaacttgccttctacctgctctccttcttctattacctgtacagtatggtttatacgttggtgagtttctaa

SEQ ID NO: 6651 - DNA, 186 bp, Artificial Sequence
  Synthetic polypeptide
tcctaagacatggacctgaccaccccactctgctgctgtgtactcttcaatgcctccccccaaaatttttgtgttaaaatcatagcctttgatgagctgcggaccgacttcaagaaccccatcgaccaggggaaccctgcgcgggcagtaagtgatacatgtgctgtgccgagcgcgagcgtttaa

SEQ ID NO: 6652 - DNA, 1079 bp, Artificial Sequence
  Synthetic polypeptide
caccgtctccctctgatgccgagccgaggctggactgtactgccaccatcttgactcactgcaacctccctgcctgattctcctgcctcagtctgccgagttcctgggattgcaggattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataa

SEQ ID NO: 6653 - DNA, 1222 bp, Artificial Sequence
  Synthetic polypeptide
gaaagggcatcttcatatactgctagtttgagtgtgaattggtacaatttgcctgcagtgtggctctaggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtga

SEQ ID NO: 6654 - DNA, 451 bp, Artificial Sequence
  Synthetic polypeptide
gaaagggcatcttcatatactgctagtttgagtgtgaattggtacaatttgcctgcagtgtggctctaggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatgagagcagtatctttattgaggatgccattaagtatttcaaggaaaaagtga

SEQ ID NO: 6655 - DNA, 292 bp, Artificial Sequence
  Synthetic polypeptide
gaaagggcatcttcatatactgctagtttgagtgtgaattggtacaatttgcctgcagtgtggctctaggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgact

SEQ ID NO: 6656 - DNA, 504 bp, Artificial Sequence
  Synthetic polypeptide
gaaagggcatcttcatatactgctagtttgagtgtgaattggtacaatttgcctgcagtgtggctctaggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgc

SEQ ID NO: 6657 - DNA, 449 bp, Artificial Sequence
  Synthetic polypeptide
gaaagggcatcttcatatactgctagtttgagtgtgaattggtacaatttgcctgcagtgtggctctaggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatgagagcagtatctttattgaggatgccattaagtatttcaaggaaaaagt

SEQ ID NO: 6658 - DNA, 454 bp, Artificial Sequence
  Synthetic polypeptide
gaaagggcatcttcatatactgctagtttgagtgtgaattggtacaatttgcctgcagtgtggctctaggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatggtagttgtactcaatgctgtggagtttgagacattatttttaaactttaaatag

SEQ ID NO: 6659 - DNA, 3701 bp, Artificial Sequence
  Synthetic polypeptide
ggccgggtgtggtggctcatgcctataatcccaacactttgggaggccgaggcgggtggatcacctgaagtcaggagtttgagaccaccttggccaacacggtgaaacacctgtaatcccagctactcgggaggctgaggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctga

SEQ ID NO: 6660 - DNA, 3527 bp, Artificial Sequence
  Synthetic polypeptide
ggccgggtgtggtggctcatgcctataatcccaacactttgggaggccgaggcgggtggatcacctgaagtcaggagtttgagaccaccttggccaacacggtgaaacacctgtaatcccagctactcgggaggctgaggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctga

SEQ ID NO: 6661 - DNA, 457 bp, Artificial Sequence
  Synthetic polypeptide
ggccgggtgtggtggctcatgcctataatcccaacactttgggaggccgaggcgggtggatcacctgaagtcaggagtttgagaccaccttggccaacacggtgaaacacctgtaatcccagctactcgggaggctgaggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaagg

SEQ ID NO: 6662 - DNA, 359 bp, Artificial Sequence
  Synthetic polypeptide
ggccgggtgtggtggctcatgcctataatcccaacactttgggaggccgaggcgggtggatcacctgaagtcaggagtttgagaccaccttggccaacacggtgaaacacctgtaatcccagctactcgggaggctgaggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcag

SEQ ID NO: 6663 - DNA, 588 bp, Artificial Sequence
  Synthetic polypeptide
ggccgggtgtggtggctcatgcctataatcccaacactttgggaggccgaggcgggtggatcacctgaagtcaggagtttgagaccaccttggccaacacggtgaaacacctgtaatcccagctactcgggaggctgaggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctgg

SEQ ID NO: 6664 - DNA, 946 bp, Artificial Sequence
  Synthetic polypeptide
ggctgagcatgggagctcacacctgtaatcctggcactgttaaagattgaggcaggcggatcacttgaggtcaggagttgaagaccagcctggccaacgtgatgaaactctgtctctactaaaaatacaaaaattagccaggagtggcaggcgcctgtaatcccagctactctggaggctgaggcaggagaattgcttgaagccaggaggcggacattacagtaagatcagcaatgtcttatttttcattttaccgcccatctgcatgtgcttgtttcgtcagtatgcaacatgcttcaacagtggcatctacttaatctggactcttttggttgtagtgggaattggatccgtctacttccatgcaacccttagtttcttgggtcagatgcttgatgaacttgcagtcctttgggttctgatgtgtgctttggccatgtggttccccagaaggtatctaccaaagatctttcggaatgaccggggtaggttcaaggtggtggtcagtgtcctgtctgcggttacgacgtgcctggcatttgtcaagcctgccatcaacaacatctctctgatgaccctgggagttccttgcactgcactgctcatcgcagagctaaagaggtgtgacaacatgcgtgtgtttaagctgggcctcttctcgggcctctggtggaccctggccctgttctgctggatcagtgaccgagctttctgcgagctgctgtcatccttcaacttcccctacctgcactgcatgtggcacatcctcatctgccttgctgcctacctgggctgtgtatgctttgcctactttgatgctgcctcagagattcctgagcaaggccctgtcatcaagttctggcccaatgagaaatgggccttcattggtgtcccctatgtgtccctcctgtgtgccaacaagaaatcatcagtcaagatcacgtga

SEQ ID NO: 6665 - DNA, 767 bp, Artificial Sequence
  Synthetic polypeptide
tgccctgaaatcttaattctgttttgtgaggtctgatggatcagtggagcatctacggggcttggagcctctgctcaggcacagtcctgtctcccagcctccctgcctccctggcacagattctctgctgcctacttctgtgctccctggagcctcagtgcaaggcctcccccatctctgtcactgtcctgagatgctgcagcactctgcccccagcaggagcctgggcatggggagggctggggttgggcacatgtgccactcagcatcttcatggcatcagtcgtccctgccctgcaagggcatttggtgggcaacttgggagggatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagccgctgggcctccactgcaccttcattgatgacttcactccataccacatgctgcatggggaggtgcactgtggcaccaatgtgtgcagaaagcccttctctttcaagtggtggaacatggtgccctga

SEQ ID NO: 6666 - DNA, 427 bp, Artificial Sequence
  Synthetic polypeptide
gaaacctggctctgccacttcccaagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactga

SEQ ID NO: 6667 - DNA, 370 bp, Artificial Sequence
  Synthetic polypeptide
gaaacctggctctgccacttcccaagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatttcagcttaa

SEQ ID NO: 6668 - DNA, 436 bp, Artificial Sequence
  Synthetic polypeptide
gaaacctggctctgccacttcccaagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagaaaaggaaatcctcgcttccatggctgccaaaaggacagtgtttctggctctcagccctaaggccctgcaaactctaa

SEQ ID NO: 6669 - DNA, 445 bp, Artificial Sequence
  Synthetic polypeptide
gaaacctggctctgccacttcccaagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggcacctgttatcttgtcttaaaacgctggtcagactggatggtcctgagctttcttccactgctgctgtcctgtgactttgaggggagcgtctctacccccttatccatgatgtccacacccagctggctggcaagatcacgggcatgctgctggagattgacaactcagagctgttgctcatgctggagtctccagaatccctccatgccaagatag

SEQ ID NO: 6670 - DNA, 433 bp, Artificial Sequence
  Synthetic polypeptide
gaaacctggctctgccacttcccaagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaaggcccagagacggaaagtacaaagactagtaaaatacatccttgcccttaaggagctaagtacccaaaacctgtaa

SEQ ID NO: 6671 - DNA, 163 bp, Artificial Sequence
  Synthetic polypeptide
ggcctgagttttctcacgtgtagaatggagccccaacccccgcctgaccttctgcgtcaaaacctacgaacgccttttctacatggtggctccgagccccgaagccatgcgcatttggatggacgtcatcgtgaccgccgctgacgaaaaccacgccccctga

SEQ ID NO: 6672 - DNA, 1389 bp, Artificial Sequence; identical to SEQ ID NO: 863
  Synthetic polypeptide

SEQ ID NO: 6673 - DNA, 1211 bp, Artificial Sequence; identical to SEQ ID NO: 526
  Synthetic polypeptide

SEQ ID NO: 6674 - DNA, 1133 bp, Artificial Sequence; identical to SEQ ID NO: 527
  Synthetic polypeptide

SEQ ID NO: 6675 - DNA, 841 bp, Artificial Sequence; identical to SEQ ID NO: 529
  Synthetic polypeptide

SEQ ID NO: 6676 - DNA, 659 bp, Artificial Sequence; identical to SEQ ID NO: 530
  Synthetic polypeptide

SEQ ID NO: 6677 - DNA, 2535 bp, Artificial Sequence
  Synthetic polypeptide
ctgtaagacctgcactttgggaggccaaggcgggtggctcacctgaggtcagtagttcaagaccagcctggccaacatggtgaaatcccatctctactaaaaatacaaaaaaatagctggatgtggtggtgggcgcctgtcatcccagctactcgggaggctgaggcaggagaatcgcatgaacccaggaggcagaggttgcagtgagccaagatcacaccattgcactccagcctgggcgaagaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaa

SEQ ID NO: 6678 - DNA, 2181 bp, Artificial Sequence
  Synthetic polypeptide
ctgtaagacctgcactttgggaggccaaggcgggtggctcacctgaggtcagtagttcaagaccagcctggccaacatggtgaaatcccatctctactaaaaatacaaaaaaatagctggatgtggtggtgggcgcctgtcatcccagctactcgggaggctgaggcaggagaatcgcatgaacccaggaggcagaggttgcagtgagccaagatcacaccattgcactccagcctgggcgaagaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaaggtcctggggaactggggctga

SEQ ID NO: 6679 - DNA, 1119 bp, Artificial Sequence
  Synthetic polypeptide
ctgtaagacctgcactttgggaggccaaggcgggtggctcacctgaggtcagtagttcaagaccagcctggccaacatggtgaaatcccatctctactaaaaatacaaaaaaatagctggatgtggtggtgggcgcctgtcatcccagctactcgggaggctgaggcaggagaatcgcatgaacccaggaggcagaggttgcagtgagccaagatcacaccattgcactccagcctgggcgaagaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggccgcgagagaagggagacacgcagccacaactgtcaccctcgacacccccacccgcgctctcccctgaaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatag

SEQ ID NO: 6680 - DNA, 1861 bp, Artificial Sequence
  Synthetic polypeptide
tgaaaccaccttgctaaggttatgatggttagagaaatccaacacagctgactttatcttgcttctgaccccagaagctgactatctgctcattcctgggtgtaggtcaagctaactaaaaaggagtttagtttacagtttaactttaaagcaaggatgataatagtcccttcctgaaactggtccccttcttgcttgggaactgaaactgcatttgtaaaactaatgaaagtcaataagattagaattatgataagggcctgaattctgctaagtaataagcacagtgaagaagagataaccagccattgttccctagcttggttactgctggaggtcacaagatttgagataacatcaccactgtaaaccctaagatgggtttttgagatatttttcagacctttgcattctggtaaactgactgatgccatctggaccatgactcataccaaggaacagactcaactcgtcctgtgacccccacctagaaactgactcagcacgtgaagacagttccaacactccagtgatttcatctccaaccaatcagtagcatacattccctggccctcagcttgccaaattatccttaaaaaccctgggctccaagctttcgaggaggtggatttgagagatacctcccctccttctgctcagctgccttgcagtaattaaactctttctctgctgcaacacccctactgttctccgtgtattggcttttctgggcagcaggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaa

SEQ ID NO: 6681 - DNA, 1123 bp, Artificial Sequence
  Synthetic polypeptide
tgaaaccaccttgctaaggttatgatggttagagaaatccaacacagctgactttatcttgcttctgaccccagaagctgactatctgctcattcctgggtgtaggtcaagctaactaaaaaggagtttagtttacagtttaactttaaagcaaggatgataatagtcccttcctgaaactggtccccttcttgcttgggaactgaaactgcatttgtaaaactaatgaaagtcaataagattagaattatgataagggcctgaattctgctaagtaataagcacagtgaagaagagataaccagccattgttccctagcttggttactgctggaggtcacaagatttgagataacatcaccactgtaaaccctaagatgggtttttgagatatttttcagacctttgcattctggtaaactgactgatgccatctggaccatgactcataccaaggaacagactcaactcgtcctgtgacccccacctagaaactgactcagcacgtgaagacagttccaacactccagtgatttcatctccaaccaatcagtagcatacattccctggccctcagcttgccaaattatccttaaaaaccctgggctccaagctttcgaggaggtggatttgagagatacctcccctccttctgctcagctgccttgcagtaattaaactctttctctgctgcaacacccctactgttctccgtgtattggcttttctgggcagcaggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaacccataggcatgaaatga

SEQ ID NO: 6682 - DNA, 774 bp, Artificial Sequence
  Synthetic polypeptide
tttcttggttccctgaccggcaagcgaggtgagtaatggacggtccaggcagcttcttaagcggctttagcctgccctgtggaacatccctgcgggggactccaaccagccggagcgacgcggatcctgagagcgctcccgggtaggcatttgccccggtgggatgcctcgccagagccgtgtgtggcaggcccccgtggaggatcaacgcagtggctgaacaccgggaaggaactggcacttggcacttggagtccggacgtctcaaactcggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaa

SEQ ID NO: 6683 - DNA, 768 bp, Artificial Sequence
  Synthetic polypeptide
tttcttggttccctgaccggcaagcgaggtgagtaatggacggtccaggcagcttcttaagcggctttagcctgccctgtggaacatccctgcgggggactccaaccagccggagcgacgcggatcctgagagcgctcccgggtaggcatttgccccggtgggatgcctcgccagagccgtgtgtggcaggcccccgtggaggatcaacgcagtggctgaacaccgggaaggaactggcacttggcacttggagtccggacgtctcaaactcggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagagaagggaaaatggagacacaggagtggggagagtttgagaagatggtag

SEQ ID NO: 6684 - DNA, 1765 bp, Artificial Sequence
  Synthetic polypeptide
aggcataccttgtcttattgcacttagctttattgtattttatggatactttgctttttataaattgaaggtttttggcaaccttgccccaagcaagtctgtcagtaccatttttccaacaacatgtgttcactttgtgtctgtgtgtcaaattttggtaattcttacagtatttcaaacttcttcatgatttattgtgtccgttagtgatctttgatgttgctattgtaattgttgggcgggggggcaccatgaaatgtgcccataaaagttactgaatttatttgataaatgaaatgctgtgtgtgttctgaccactccacccaccagccgttccccatctctctccctctcagacttccctatttccttagacacaacaatattgaaactaggccagttaataaccgtattatggcctctcggtgtccaagtgaaagaaagtgtcccatgtctgttacttaaaatccaaagctagaaatgattgagcttagtgaagaaggcatgtgaaaagccaaataggccaaaagctaggcctcaacaccaaatattagtcaagttatgaaagcaaaggaaaattcttgaaggaaattaaaagtgctactccagtgaacgcacaaatgataagaaagcagaacatccttattgctgatatggagaaagtttcagtggtctggatagaatatcaaaccagccacaacattcttttaagccaaaccataatccagaccaagatcctaactcttgaattctgtgaaggctgagacaggtgaggaagctacaaaagaaaagtttgaagctagcagaggttggttcatgaggtttaaggaaagaagccatctccataacagaaaagtacaaggtgaagcagcagatgctgttgtagaagctgcagcaagttatccggaagacctagctaagatcattgacggtgggtacactcaacaacagattttcaatgtagacggaatagccttctattggaagaaagtgacatctggaacttgcacagctagagagaagtcaatgcctggtttccaagatgcaaagatcagagtgattcccttgttagggactaatgcagctggtgattttacattgaagccaaagctcatttagcattctgaaaattgtagggcccttaagaaggtggggctaaatctactctgcctgtgctctgtaaatagaacaacaaagtctggatgacaacacatctgtttacagcatggtttactgaatattttttaagccccccattaagaggtactgttcagaaaaatagattcctttcaaaatattacagtgcacctcattaccctaaagctcagatggagatgtttcatgcctgcaacatccaatcttcggcttatggatcaaggagtaattttgactttcaagtcttattacttaagaaatacattttataaagctatagctgccctggatagtggttcctttgatggatctggacaaagtaaattgaaaacctggaaaggattcaccattctacacgcccttaagaacatttgtgattcatgggaggaggttaaactatgaacataaagaggagtttggaagaaattgattccaacccttcagccctcatggatgactttgagggattgaggacttccatggagggagtaactgcagatgtggaggaaatgagcatagcggcctgaccacaggggtggccttcgggcatcacgccaagttcatcgcttcaacaggcatggacagaagcctcaagttctacagcctgtag

SEQ ID NO: 6685 - DNA, 1257 bp, Artificial Sequence; identical to SEQ ID NO: 625
  Synthetic polypeptide

SEQ ID NO: 6686 - DNA, 1215 bp, Artificial Sequence; identical to SEQ ID NO: 626
  Synthetic polypeptide

SEQ ID NO: 6687 - DNA, 507 bp, Artificial Sequence; identical to SEQ ID NO: 628
  Synthetic polypeptide

SEQ ID NO: 6688 - DNA, 313 bp, Artificial Sequence; identical to SEQ ID NO: 629
  Synthetic polypeptide

SEQ ID NO: 6689 - DNA, 291 bp, Artificial Sequence; identical to SEQ ID NO: 630
  Synthetic polypeptide

SEQ ID NO: 6690 - DNA, 1224 bp, Artificial Sequence
  Synthetic polypeptide
catggctcctggaaggactaaatgaagtcatgagtataaagtgctcctgcatggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaaccagcatggtgaggacaccttcaaccgggccaagctgcttaacgtgggcttcctagaggcgctgaaggaggatgccgcctatgactgcttcatcttcagcgatgtggacctggtccccatggatgaccgcaacctataccgctgcggcgaccaaccccgccactttgccattgccatggacaagtttggcttccggcttccctatgctggctactttggaggtgtgtcaggcctgagtaaggctcagtttctgagaatcaatggcttccccaatgagtactggggctggggtggcgaggatgatgacatcttcaaccggatctccctgactgggatgaagatctcacgcccagacatccgaatcggccgctaccgcatgatcaagcacgaccgcgacaagcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctga

SEQ ID NO: 6691 - DNA, 1731 bp, Artificial Sequence
  Synthetic polypeptide
gccaacatggcaaaaacctgtctcgagtaaaattggaaaaatcagccaggcatggtgatgcaccactcctgtaatcccagctacttgtgtacctgaggcaggaggatcgcttgaacctgggaggcagaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatga

SEQ ID NO: 6692 - DNA, 2019 bp, Artificial Sequence
  Synthetic polypeptide
gccaacatggcaaaaacctgtctcgagtaaaattggaaaaatcagccaggcatggtgatgcaccactcctgtaatcccagctacttgtgtacctgaggcaggaggatcgcttgaacctgggaggcagaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatga

SEQ ID NO: 6693 - DNA, 2043 bp, Artificial Sequence
  Synthetic polypeptide
gccaacatggcaaaaacctgtctcgagtaaaattggaaaaatcagccaggcatggtgatgcaccactcctgtaatcccagctacttgtgtacctgaggcaggaggatcgcttgaacctgggaggcagaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatga

SEQ ID NO: 6694 - DNA, 554 bp, Artificial Sequence
  Synthetic polypeptide
gccaacatggcaaaaacctgtctcgagtaaaattggaaaaatcagccaggcatggtgatgcaccactcctgtaatcccagctacttgtgtacctgaggcaggaggatcgcttgaacctgggaggcagaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttggtaattttaatatttgcggaagtgactcaagaagttgaagtagcaagacctgtagacaaggcaatatgtggtttaacgcctgggaggagatacagaaaccagcctcgaggtccagttggaaa

SEQ ID NO: 6695 - DNA, 1024 bp, Artificial Sequence
  Synthetic polypeptide
gtgaaaagagccaggacactggaggccagcagatagcagtgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagctgaaagatctgttgactgaattgcagaaaaaacttgatgattcatattctgaagcagtaagacagaatgaagagctaaatttgttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtga

SEQ ID NO: 6696 - DNA, 940 bp, Artificial Sequence
  Synthetic polypeptide
gtgaaaagagccaggacactggaggccagcagatagcagtgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtga

SEQ ID NO: 6697 - DNA, 274 bp, Artificial Sequence
  Synthetic polypeptide
ggtcgggcgcggtggctcacgtctgtaatcccagcactttggaaggccgaggctacggaaaaacctgcgagccctggtggttgtccatgctacatggtatgtgaaagcatttctggcactgcttcggcccttcatcagttccaaattcacacgaaaaatccgttttctggacagcctgggggagctggcccaactcatatccctggatcaagtccacatccctgaagctgtcagacagctggaccgggatctccatggctcaggagggacatag

SEQ ID NO: 6698 - DNA, 1327 bp, Artificial Sequence
  Synthetic polypeptide
cctggttctgctacctaccagctgagttactttggtcaagctcttggacttctgaggctgtttcctaatttcaaaattaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtagccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttaaaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggttgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcggccaccacatgtcctcatgcccagggtcttccggcaggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgccgagaacagggagctaaacatcaccatcatctaa

SEQ ID NO: 6699 - DNA, 1291 bp, Artificial Sequence
  Synthetic polypeptide
cctggttctgctacctaccagctgagttactttggtcaagctcttggacttctgaggctgtttcctaatttcaaaattaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtagccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttaaaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggttgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgccgagaacagggagctaaacatcaccatcatctaa

SEQ ID NO: 6700 - DNA, 1273 bp, Artificial Sequence
  Synthetic polypeptide
taagcaaaaagaaaagtctggaggcatcacattacctgatttcaaactatactgtaaggccatagtcaccaaaaacatcatggtactggcataaaaacaagcacatagatcaatggaacagaatagagaacccagaaattaacccaaatacttacagccaactgatcttcgacaaagcaaacaaaaacataaagtggggaaaggacaccctattcaacaaatggtgctgccaatgtaggagaatgaaactggatcctcatctcccaccttatacaaaaatcaactcaagatggattaaggacttacttacatctacgacctgaaactataaaaattgtagaagacaacttaggaaaaacccttctagacattggcttaggcaaggatttcatgaccaagaacccaaaagcaaatgcaataaagacaaagataaatagctgagacttaattaaactaaagagcttttacacagcaaaaggaacagtcagcaaagtgaacagacaacccacagagtgggagaagatctttacaatctgtacatctgacaaaggactaatacccagaatctataacgaactcaatcaaatcagcaagaaaaaaaacaatcacatcaaaaagtgggctaaggacatgaatagacaattctaaaaagaagacatacaaatggccaaaaaatatatgaaaaaatgctcaacatcactaatgatcagagaaatgcaaatcaaaaccacaatgcagtaccaccttactcctgcaagaatggccgtaatcaaaaaaatcaaaaaacagtagatgtttggcatggatgtggtgaagagggaacacttctacactgcaggtgggaatgtaaactagtacagccattatggaaaacggtgtggagattccttaaagaactaaaagtagaactaccatttgatccagcaatcccactactgggtatctacccagaggaaaagaagtcattatatgaaaaagatacttgtacacatatatttatagcagcacaacttgcaactgtgaaatcatgggaccaacccaaatgtccatcagtcaacgagtggataaagaaactgtggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttag

SEQ ID NO: 6701 - DNA, 1357 bp, Artificial Sequence
  Synthetic polypeptide
taagcaaaaagaaaagtctggaggcatcacattacctgatttcaaactatactgtaaggccatagtcaccaaaaacatcatggtactggcataaaaacaagcacatagatcaatggaacagaatagagaacccagaaattaacccaaatacttacagccaactgatcttcgacaaagcaaacaaaaacataaagtggggaaaggacaccctattcaacaaatggtgctgccaatgtaggagaatgaaactggatcctcatctcccaccttatacaaaaatcaactcaagatggattaaggacttacttacatctacgacctgaaactataaaaattgtagaagacaacttaggaaaaacccttctagacattggcttaggcaaggatttcatgaccaagaacccaaaagcaaatgcaataaagacaaagataaatagctgagacttaattaaactaaagagcttttacacagcaaaaggaacagtcagcaaagtgaacagacaacccacagagtgggagaagatctttacaatctgtacatctgacaaaggactaatacccagaatctataacgaactcaatcaaatcagcaagaaaaaaaacaatcacatcaaaaagtgggctaaggacatgaatagacaattctaaaaagaagacatacaaatggccaaaaaatatatgaaaaaatgctcaacatcactaatgatcagagaaatgcaaatcaaaaccacaatgcagtaccaccttactcctgcaagaatggccgtaatcaaaaaaatcaaaaaacagtagatgtttggcatggatgtggtgaagagggaacacttctacactgcaggtgggaatgtaaactagtacagccattatggaaaacggtgtggagattccttaaagaactaaaagtagaactaccatttgatccagcaatcccactactgggtatctacccagaggaaaagaagtcattatatgaaaaagatacttgtacacatatatttatagcagcacaacttgcaactgtgaaatcatgggaccaacccaaatgtccatcagtcaacgagtggataaagaaactgtggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcaaaccttgaaacagccctcattaagtctactctcgagccggccctgtgtgccttttttctttga

SEQ ID NO: 6702 - DNA, 1546 bp, Artificial Sequence
  Synthetic polypeptide
taagcaaaaagaaaagtctggaggcatcacattacctgatttcaaactatactgtaaggccatagtcaccaaaaacatcatggtactggcataaaaacaagcacatagatcaatggaacagaatagagaacccagaaattaacccaaatacttacagccaactgatcttcgacaaagcaaacaaaaacataaagtggggaaaggacaccctattcaacaaatggtgctgccaatgtaggagaatgaaactggatcctcatctcccaccttatacaaaaatcaactcaagatggattaaggacttacttacatctacgacctgaaactataaaaattgtagaagacaacttaggaaaaacccttctagacattggcttaggcaaggatttcatgaccaagaacccaaaagcaaatgcaataaagacaaagataaatagctgagacttaattaaactaaagagcttttacacagcaaaaggaacagtcagcaaagtgaacagacaacccacagagtgggagaagatctttacaatctgtacatctgacaaaggactaatacccagaatctataacgaactcaatcaaatcagcaagaaaaaaaacaatcacatcaaaaagtgggctaaggacatgaatagacaattctaaaaagaagacatacaaatggccaaaaaatatatgaaaaaatgctcaacatcactaatgatcagagaaatgcaaatcaaaaccacaatgcagtaccaccttactcctgcaagaatggccgtaatcaaaaaaatcaaaaaacagtagatgtttggcatggatgtggtgaagagggaacacttctacactgcaggtgggaatgtaaactagtacagccattatggaaaacggtgtggagattccttaaagaactaaaagtagaactaccatttgatccagcaatcccactactgggtatctacccagaggaaaagaagtcattatatgaaaaagatacttgtacacatatatttatagcagcacaacttgcaactgtgaaatcatgggaccaacccaaatgtccatcagtcaacgagtggataaagaaactgtggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcagccccgcagcccccgcaggccccgcagcccctgcagccccggaagaaacgggttcgtcggacgacacagcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggatgtaaagccagaaaacaagcagtaa

SEQ ID NO: 6703 - DNA, 1621 bp, Artificial Sequence
  Synthetic polypeptide
taagcaaaaagaaaagtctggaggcatcacattacctgatttcaaactatactgtaaggccatagtcaccaaaaacatcatggtactggcataaaaacaagcacatagatcaatggaacagaatagagaacccagaaattaacccaaatacttacagccaactgatcttcgacaaagcaaacaaaaacataaagtggggaaaggacaccctattcaacaaatggtgctgccaatgtaggagaatgaaactggatcctcatctcccaccttatacaaaaatcaactcaagatggattaaggacttacttacatctacgacctgaaactataaaaattgtagaagacaacttaggaaaaacccttctagacattggcttaggcaaggatttcatgaccaagaacccaaaagcaaatgcaataaagacaaagataaatagctgagacttaattaaactaaagagcttttacacagcaaaaggaacagtcagcaaagtgaacagacaacccacagagtgggagaagatctttacaatctgtacatctgacaaaggactaatacccagaatctataacgaactcaatcaaatcagcaagaaaaaaaacaatcacatcaaaaagtgggctaaggacatgaatagacaattctaaaaagaagacatacaaatggccaaaaaatatatgaaaaaatgctcaacatcactaatgatcagagaaatgcaaatcaaaaccacaatgcagtaccaccttactcctgcaagaatggccgtaatcaaaaaaatcaaaaaacagtagatgtttggcatggatgtggtgaagagggaacacttctacactgcaggtgggaatgtaaactagtacagccattatggaaaacggtgtggagattccttaaagaactaaaagtagaactaccatttgatccagcaatcccactactgggtatctacccagaggaaaagaagtcattatatgaaaaagatacttgtacacatatatttatagcagcacaacttgcaactgtgaaatcatgggaccaacccaaatgtccatcagtcaacgagtggataaagaaactgtggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcacacgacgcatcaaaccataccatagtggggctaggacccaaccaagtaccagaaatgaaggaaacgaccctgcaggccccgcagcccccgcaggccccgcagcccctgcagccccggaagaaacgggttcgtcggacgacacagcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggatgtaaagccagaaaacaagcagtaa

SEQ ID NO: 6704 - DNA, 1282 bp, Artificial Sequence
  Synthetic polypeptide
taagcaaaaagaaaagtctggaggcatcacattacctgatttcaaactatactgtaaggccatagtcaccaaaaacatcatggtactggcataaaaacaagcacatagatcaatggaacagaatagagaacccagaaattaacccaaatacttacagccaactgatcttcgacaaagcaaacaaaaacataaagtggggaaaggacaccctattcaacaaatggtgctgccaatgtaggagaatgaaactggatcctcatctcccaccttatacaaaaatcaactcaagatggattaaggacttacttacatctacgacctgaaactataaaaattgtagaagacaacttaggaaaaacccttctagacattggcttaggcaaggatttcatgaccaagaacccaaaagcaaatgcaataaagacaaagataaatagctgagacttaattaaactaaagagcttttacacagcaaaaggaacagtcagcaaagtgaacagacaacccacagagtgggagaagatctttacaatctgtacatctgacaaaggactaatacccagaatctataacgaactcaatcaaatcagcaagaaaaaaaacaatcacatcaaaaagtgggctaaggacatgaatagacaattctaaaaagaagacatacaaatggccaaaaaatatatgaaaaaatgctcaacatcactaatgatcagagaaatgcaaatcaaaaccacaatgcagtaccaccttactcctgcaagaatggccgtaatcaaaaaaatcaaaaaacagtagatgtttggcatggatgtggtgaagagggaacacttctacactgcaggtgggaatgtaaactagtacagccattatggaaaacggtgtggagattccttaaagaactaaaagtagaactaccatttgatccagcaatcccactactgggtatctacccagaggaaaagaagtcattatatgaaaaagatacttgtacacatatatttatagcagcacaacttgcaactgtgaaatcatgggaccaacccaaatgtccatcagtcaacgagtggataaagaaactgtggtttaccgacaagactgtgaaactttcgggatggtggtgaaaatgctgattgaaaaagatccttcattagaaaagtctatacagtttgcattgaggcagaatttacatgaaatagctggcgctgatacaatacaatgtttacctggccaaagagggttcgaggggacaagctggcctcacaataagatgcacagtgttagctag

SEQ ID NO: 6705 - DNA, 1639 bp, Artificial Sequence
  Synthetic polypeptide
taagcaaaaagaaaagtctggaggcatcacattacctgatttcaaactatactgtaaggccatagtcaccaaaaacatcatggtactggcataaaaacaagcacatagatcaatggaacagaatagagaacccagaaattaacccaaatacttacagccaactgatcttcgacaaagcaaacaaaaacataaagtggggaaaggacaccctattcaacaaatggtgctgccaatgtaggagaatgaaactggatcctcatctcccaccttatacaaaaatcaactcaagatggattaaggacttacttacatctacgacctgaaactataaaaattgtagaagacaacttaggaaaaacccttctagacattggcttaggcaaggatttcatgaccaagaacccaaaagcaaatgcaataaagacaaagataaatagctgagacttaattaaactaaagagcttttacacagcaaaaggaacagtcagcaaagtgaacagacaacccacagagtgggagaagatctttacaatctgtacatctgacaaaggactaatacccagaatctataacgaactcaatcaaatcagcaagaaaaaaaacaatcacatcaaaaagtgggctaaggacatgaatagacaattctaaaaagaagacatacaaatggccaaaaaatatatgaaaaaatgctcaacatcactaatgatcagagaaatgcaaatcaaaaccacaatgcagtaccaccttactcctgcaagaatggccgtaatcaaaaaaatcaaaaaacagtagatgtttggcatggatgtggtgaagagggaacacttctacactgcaggtgggaatgtaaactagtacagccattatggaaaacggtgtggagattccttaaagaactaaaagtagaactaccatttgatccagcaatcccactactgggtatctacccagaggaaaagaagtcattatatgaaaaagatacttgtacacatatatttatagcagcacaacttgcaactgtgaaatcatgggaccaacccaaatgtccatcagtcaacgagtggataaagaaactgtggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcagccctctttggattccagcacgacgcatcaaaccataccatagtggggctaggacccaaccaagtaccagaaatgaaggaaacgaccctgcaggccccgcagcccccgcaggccccgcagcccctgcagccccggaagaaacgggttcgtcggacgacacagcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggatgtaaagccagaaaacaagcagtaa

SEQ ID NO: 6706 - DNA, 520 bp, Artificial Sequence
  Synthetic polypeptide
aattcaagcctcctactttctgactgtttgatctaggccctgcctgcagtactggccagagccaggccggcagcaatatggcctcatggaggtggagtttatgtcgggcacagctgatgaagacttagtggctcgagtcttccgggtgcagaacatctctcggttgcaggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatag

SEQ ID NO: 6707 - DNA, 514 bp, Artificial Sequence
  Synthetic polypeptide
aattcaagcctcctactttctgactgtttgatctaggccctgcctgcagtactggccagagccaggccggcagcaatatggcctcatggaggtggagtttatgtcgggcacagctgatgaagacttagtggctcgagtcttccgggtgcagaacatctctcgggaggggcacctgctggtgcggcacttccagttcctgcgctggtctgcataccgggacacacctgactccaagaaggccttcttgcacctgctggctgaggtggacaagtggcaggccgagagtggggatgggcgcaccatcgtgcactgcctaaacgggggaggacgcagcggcaccttctgcgcctgcgccacggtcctggagatgatccgctgccacaacttggtggacgttttctttgctgccaaaaccctccggaactacaaacccaacatggtggagaccatggatcagtaccacttttgctacgatgtggccctggagtacttggaggggctggagtcaagatag

SEQ ID NO: 6708 - DNA, 1291 bp, Artificial Sequence; identical to SEQ ID NO: 6699
  Synthetic polypeptide

SEQ ID NO: 6709 - DNA, 290 bp, Artificial Sequence
  Synthetic polypeptide
ggctgggcgcagtggctcatgcctgtaatcccaacactttgggaggccgaggtgggcggatcacaaggctacggaaaaacctgcgagccctggtggttgtccatgctacatggtatgtgaaagcatttctggcactgcttcggcccttcatcagttccaaattcacacgaaaaatccgttttctggacagcctgggggagctggcccaactcatatccctggatcaagtccacatccctgaagctgtcagacagctggaccgggatctccatggctcaggagggacatag

SEQ ID NO: 6710 - DNA, 1730 bp, Artificial Sequence
  Synthetic polypeptide
ggccaggtgcagtggcctgtaataacagcactttgagaggcaaagacagaaggatcccttgaggccaggagttggagaacagcctgggcaacatagcaagatcccacttctaaaaaaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggacaagcttcagcgcatgggggagccctacagcccgtgcaccgtgaatggttctgaggtccccgtccaaaacttctacagtgactacaacacgacctactccatccaggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaa

SEQ ID NO: 6711 - DNA, 698 bp, Artificial Sequence
  Synthetic polypeptide
ggccaggtgcagtggcctgtaataacagcactttgagaggcaaagacagaaggatcccttgaggccaggagttggagaacagcctgggcaacatagcaagatcccacttctaaaaaaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggcctgaagttgatcctggacataggccaggaagactacgtccccttccttgcgtccacggccggggtcaggctgatgcttcacgagcagaggtcataccccttcatcagagatga

SEQ ID NO: 6712 - DNA, 1622 bp, Artificial Sequence
  Synthetic polypeptide
ggccaggtgcagtggcctgtaataacagcactttgagaggcaaagacagaaggatcccttgaggccaggagttggagaacagcctgggcaacatagcaagatcccacttctaaaaaaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaa

SEQ ID NO: 6713 - DNA, 1649 bp, Artificial Sequence
  Synthetic polypeptide
ggccaggtgcagtggcctgtaataacagcactttgagaggcaaagacagaaggatcccttgaggccaggagttggagaacagcctgggcaacatagcaagatcccacttctaaaaaaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactagccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggacaagcttcagcgcatgggggagccctacagcccgtgcaccgtgaatggttctgaggtccccgtccaaaacttctacagtgactacaacacgacctactccatccaggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaa

SEQ ID NO: 6714 - DNA, 279 bp, Artificial Sequence
  Synthetic polypeptide
aatggaaaagtctggagattggagccaggcaaaaaaatctgcatttcggttgtctagaactacctgagtgacttcggctgcttcctaccgaacctgaattttctgtgatgtggagacatttaataccacctttagggaactggcttaaggactggagactgggctggcttagatgaagatgaagatgcacatgtctgggaggataattgggatgatgacaatgtagaggatgacttctctaatcagttacgggctggatacagtgaactggaggaatag

SEQ ID NO: 6715 - DNA, 270 bp, Artificial Sequence
  Synthetic polypeptide
aatggaaaagtctggagattggagccaggcaaaaaaatctgcatttcggttgtctagaactacctgagtgacttcggctgcttcctaccgaacctgaattttctgtgatgtggagacatttaataccacctttagggaactggcttaaggactggagactgggctggcttagatgaagatgaagatgcacatgtctgggaggataattgggatgatgacaatgtagaggatgacttctctaatcagttacgctgtgagaaaaagccctga

SEQ ID NO: 6716 - DNA, 351 bp, Artificial Sequence
  Synthetic polypeptide
aatggaaaagtctggagattggagccaggcaaaaaaatctgcatttcggttgtctagaactacctgagtgacttcggctgcttcctaccgaacctgaattttctgtgatgtggagacatttaataccacctttagggaactggcttaaggactggagactgggctggcttagatgaagatgaagatgcacatgtctgggaggataattgggatgatgacaatgtagaggatgacttctctaatcagttacgggcaactgtactcctgatgatattggtctgtgaaaccccgtatggctgctatgttctccaccaaaagggaagaatgtgcagtgctttcctctgctgttaa

SEQ ID NO: 6717 - DNA, 294 bp, Artificial Sequence
  Synthetic polypeptide
aatggaaaagtctggagattggagccaggcaaaaaaatctgcatttcggttgtctagaactacctgagtgacttcggctgcttcctaccgaacctgaattttctgtgatgtggagacatttaataccacctttagggaactggcttaaggactggagactgggctggcttagatgaagatgaagatgcacatgtctgggaggataattgggatgatgacaatgtagaggatgacttctctaatcagttacgagctgaactagagaaacatggttataagatggagacttcatag

SEQ ID NO: 6718 - DNA, 1046 bp, Artificial Sequence; identical to SEQ ID NO: 631
  Synthetic polypeptide

SEQ ID NO: 6719 - DNA, 968 bp, Artificial Sequence; identical to SEQ ID NO: 632
  Synthetic polypeptide

SEQ ID NO: 6720 - DNA, 676 bp, Artificial Sequence; identical to SEQ ID NO: 634
  Synthetic polypeptide

SEQ ID NO: 6721 - DNA, 494 bp, Artificial Sequence; identical to SEQ ID NO: 635
  Synthetic polypeptide

SEQ ID NO: 6722 - DNA, 961 bp, Artificial Sequence
  Synthetic polypeptide
ggctgggtgtggtggctcacacctgtaatcccagcactttaagaggccaaggcaggaggagcgcttgagcccagaagtttgagaccaggctgtgcaacatagcaagacccccgtctctacaaaaaattaaaaaatttagccagggtttttggagtctctggatgatttttacattcttagcagtggattgatattgctgcagaccacaaacagtgtgtttaataaaaccctgctaaagcaggtaatacccgagactctcctgtcctggcaaagagtccgtgtggccaatatgatggcagatagtggcaagaggtgggcagacatcttttcaaaatacaactctggcacctataacaatcaatacatggttctggacctgaagaaagtaaagctgaaccacagtcttgacaaaggcactctgtacattgtggagcaaattcctacatatgtagaatattctgaacaaactgatgttctacggaaaggatattggccctcctacaatgttcctttccatgaaaaaatctacaactggagtggctatccactgttagttcagaagctgggcttggactactcttatgatttagctccacgagccaaaattttccggcgtgaccaagggaaagtgactgatacggcatccatgaaatatatcatgcgatacaacaattataagaaggatccttacagtagaggtgacccctgtaataccatctgctgccgtgaggacctgaactcacctaacccaagtcctggaggttgttatgacacaaaggtggcagatatctacctagcatctcagtacacatcctatgccataagtggtcccacagtacaaggtggcctccctgtttttcgctgggaccgtttcaacaaaactctacatcagggcatgccagaggtctacaactttgattttattaccatgaaaccaattttgaaacttgatataaaatga

SEQ ID NO: 6723 - DNA, 303 bp, Artificial Sequence
  Synthetic polypeptide
agtagaacgaacaggccctggtgcgaggaagggtttgacccaggctctgccattgccacctgcatgactaggatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaa

SEQ ID NO: 6724 - DNA, 189 bp, Artificial Sequence
  Synthetic polypeptide
agtagaacgaacaggccctggtgcgaggaagggtttgacccaggctctgccattgccacctgcatgactaggatggagaaggatgaaactgtgagtgactgctccccacacatagccaacatcgggcgcctggtagaggtctgtgcagacttttgcagacaaatcaaaacaagaagctctgaagaatga

SEQ ID NO: 6725 - DNA, 318 bp, Artificial Sequence
  Synthetic polypeptide
agtagaacgaacaggccctggtgcgaggaagggtttgacccaggctctgccattgccacctgcatgactaggatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgagatctattgatgctatccctgacaaccaaaagtttaagcagttgcagagggagctctctcaagtgctgacccagcgccagatctacatccagcctgataattaa

SEQ ID NO: 6726 - DNA, 138 bp, Artificial Sequence
  Synthetic polypeptide
agtagaacgaacaggccctggtgcgaggaagggtttgacccaggctctgccattgccacctgcatgactaggatggagaaggatgaaactgtgagtgactgctccccacacatagccaacatcgggcgcctggtagag

SEQ ID NO: 6727 - DNA, 2825 bp, Artificial Sequence
  Synthetic polypeptide
caggttatgaaacaaattgattctagcaggccagacttaagagagatgagccccttgaccatcccaaggcagagtggttaacagatgcaagttgttttatgcatcaggaaaacaggagggctagatatgctattattagcacaagataatcaaggcacaagccttgctggcctcgacctcagctcaaaaagctgagttaattgaacttactaggcccctgcagttggaaaggatttaaaagttaacatttacactgattccaagtatgattttttagtgcttcatgcttatgctgcaatttggaatgggtggggactcctgaccccaaagggcttttccatacatcattcagattttgagcttgttagaatgctgctttgctgccaaaaagtgactataattaattgcagaggacatcaaaagagagactgaccatgtaaaaggaaatgcccttgtagatgccacagccaaggcccctgcactgaaagggccaatgaagcttgtgggcgtgctggtcagcatacatagaactgggccggaataccctgaagaagaacaaaaatgggccagggattgcatttcagtccagggcccctcaggctgaatgatggtaataaattactaatgccaagtaccaatcacaggagtataactcagcactttcatgattcttttcaccctagaagggattctttgtttctgttaatgtctcatttgtttataggggtaaatcttttcaagacactaaaacaggtgactcagccctgtgagctctgtgcctgacatgacccaaacggccagcaattttctccttctccagttaaacctgtccaaaattgaggaacctatccaggtgagaactggcaactctaatgtactccgatacctttctgcaggagattcaaatatttgctaatgcttactgataccttcactggttagatcgaggcattccccaccccatctgaaaaatgtttaccagaagaaataactcctcagtttcggtaatctaaaagcctgcaaagtgacaatggcccatctttcacagcaggcgtaacccaacacctatcctcagctttaagaatccaatattaccttcactctgtgtggagaccgcagtcctctggaaaggtgaaagggctaatcctactctacagaagactccagctaaatcagacgcctgactatctccaacacccatagcttactgcgggtttgaactgctccaaagtaaaacgtataattaagtcctgttgagttaacatatggaaggcctttcctaaccacagatctcctaatagatgaaatgaatctccattacaaaaatatcaatctaggacaggtgcaaaggcactccgtgcatatggaaacaagcgtcttcccctcccacatgggaggaaaattcagtttcagctcagctagggatctagtcttactaaagacgtgggaagaagttctccagctgagcagctttccccaacgtggaagggaccatagcaaggacacctgagttctccaacagacgttcaacgccaagggattcacagttctgggaggtgatctctgatgaacatgccatcgactccgctggcacctaccacggggacagccacctgcagctggagcgcatcaacgtgcaccaccacgaggccagcggtggcaggtacgtgccccgcgctgtgctcgtggatctggagccgggcaccatggactctgtgcactcggggcccttcgggcaggtcttcaggccagacaacttcatttccggtcagtgtggggccggaaacaactgggccaagggacgctacacagaaggcgcggagctgacggagtcagtgatggacgttgtcagaaaggaggctgagagctgtgactgcctgcagggtttccagctgacccactccctgggtggggggactgggtctgggatgggtacccttctcattagtaagatccgggaggagtacccagacaggatcataaacacattcagcatcctgccctcgcccaaggtgtcggacaccgtggtggagccctacaacgccaccctctcagtccaccagctcatagaaaacgcggatgagaccttctgcatagataacgaagcgctatatgacatatgttccaggaccctaaaactgcccacacccacctatggtgacctgaaccacctggtgtctgctaccatgagtggggtcaccacatgcctgcgcttcccaggccagctgaatgctgacctgcggaagctggccgtgaacatggtcccgtttccccggctgcatttcttcatgcccggctttgccccactgaccagccggggcagccagcagtaccgggccttgactgtggctgagctcacccagcagatgtttgatgctaagaacatgatggctgcctgtgacccccgtcacggctgctacctaacggtggctgccattttcaggggtcgcatgcccatgagggaggtggatgaacaaatgttcaacattcaagataagaacagcagctactttgctgactggttccccgacaacgtaaaaacagccgtctgtgacatcccaccccgggggctaaaaatgtcagccaccttcattgggaataatgcggccatccaggaactcttcacatgtgtctcagagcagtttacagcaatgttcaggcgcaaggccttcctccactggtacacgggcgagggcatggatgagatggaattcaccgaggccgagagcaacatgaacgacctggtgtctgaatatcagcaatatcaggatgccacggccgaggaggaggaggatgaggagtatgccgaggaggaggtggcctag

SEQ ID NO: 6728 - DNA, 394 bp, Artificial Sequence; identical to SEQ ID NO: 701
  Synthetic polypeptide

SEQ ID NO: 6729 - DNA, 700 bp, Artificial Sequence; identical to SEQ ID NO: 702
  Synthetic polypeptide

SEQ ID NO: 6730 - DNA, 568 bp, Artificial Sequence; identical to SEQ ID NO: 703
  Synthetic polypeptide

SEQ ID NO: 6731 - DNA, 535 bp, Artificial Sequence; identical to SEQ ID NO: 704
  Synthetic polypeptide

SEQ ID NO: 6732 - DNA, 129 bp, Artificial Sequence; identical to SEQ ID NO: 705
  Synthetic polypeptide

SEQ ID NO: 6733 - DNA, 435 bp, Artificial Sequence; identical to SEQ ID NO: 706
  Synthetic polypeptide

SEQ ID NO: 6734 - DNA, 303 bp, Artificial Sequence; identical to SEQ ID NO: 707
  Synthetic polypeptide

SEQ ID NO: 6735 - DNA, 270 bp, Artificial Sequence; identical to SEQ ID NO: 708
  Synthetic polypeptide

SEQ ID NO: 6736 - DNA, 290 bp, Artificial Sequence
  Synthetic polypeptide
ggccaggcacggtggctcacgcctgtaatcccagcactttgggaggccgaggtgggcggatcacaaggctacggaaaaacctgcgagccctggtggttgtccatgctacatggtatgtgaaagcatttctggcactgcttcggcccttcatcagttccaaattcacacgaaaaatccgttttctggacagcctgggggagctggcccaactcatatccctggatcaagtccacatccctgaagctgtcagacagctggaccgggatctccatggctcaggagggacatag

SEQ ID NO: 6737 - DNA, 864 bp, Artificial Sequence
  Synthetic polypeptide
tgttataggaaatagaaataaagtatttgggtagacggggagaagagagtccctggcagaaaactttccttctaacataaagtagctcagaaatagctcccttctaacctcatgcagttcaaagaaatcacttctctaactaaacaagcagcctgaaagatcaggctgtaaatcacagataaacccctggagcacagaaggagggcggggagtctcctgggtaatcaccaaacttcacaatgggccccagtaaaaacagtgggccttaataagcacattcctttccctttaggacatcaagatagagaagctaaaagtggacttggggaggtgggggtggagacgtcgtgggggaggggtgttggggggatgcctgcagctgcaagaagatgtctgggaacagacacagaaactctccctctcagataagcaaaagaaggcatcacagactaagtctgcccatgtgatccaggaataaagtgagagctgataaaaaaaaaaactctgctctataaagatagcacacctggtcccaactaaatcgtcaggccctaggaggataagacatcccctcctcactggcaccacccccgccacctgccactaactccctcctcactagcccatttataaaaaccctgacatttttactaagcaactcactcgggacccatctcttcaagggagagctgttctttctttttgcctattcaactttgctccaaactcaagtctgtgtgtgtagtgtgtgttcgcgacctccgtctccttgactgttcgaccaagagccttggtggatctccttacgtagcagccaaaataaatgaagcaaaagacttgctagaaacaaccaccaaacattga

SEQ ID NO: 6738 - DNA, 154 bp, Artificial Sequence
  Synthetic polypeptide
ggaagaggccagaactggagagagacagaaccaggctacactgcagttctattccccttactagggcttggagaagatctctgcctacatgaagtccagccgcttcctcccaagacctgtgttctcaaagatggctgtctggggcaacaagtag

SEQ ID NO: 6739 - DNA, 164 bp, Artificial Sequence; identical to SEQ ID NO: 831
  Synthetic polypeptide

SEQ ID NO: 6740 - DNA, 193 bp, Artificial Sequence; identical to SEQ ID NO: 834
  Synthetic polypeptide

SEQ ID NO: 6741 - DNA, 2588 bp, Artificial Sequence
  Synthetic polypeptide
aagttaaacatggaatagctatgtgactcagcaattccaaggtaagatgtaaaagaattgaaaagaagcattcaaacaaatacttctacacaaatgttcacagcagcagcagcagcactatttgtaataaccaaaaggtagaaacaagccaagtgttcatcaactgatgagtaggtaaacaaaatgtggtctatccatacaatggaatgttattgtatgaagtgctgatacatgctgtgacatggatcagccttgaaagtatgatgctaaatgaaagacaccagacacgaaagtcacgtgttgtatgatgccatttctatggaatgtccagcataggcaagtccacagatacagagtaaactggtggttttcaaggcctggagagagacggagtggctgcttaatagtatgaagagagggatacactggctcacagtgccccacttttaactgaaaaaaccttcaacaagcttgtgggaaagtttagccagtccatctttcacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagtgtcctggaggcagcggtttctcttgggggtgaagacttgaccccattctatggtctgctgtctggtggccgggaaggaaaattctacagggagctagaagactacttctactattctcagctccgcagtcaaggcatcgacacaatggagaccagaaaggtgtcagaacacatttgcctgtcagagcttccttttgtcatgagagcaattggcttttacccatctgaagagaagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 6742 - DNA, 1964 bp, Artificial Sequence
  Synthetic polypeptide
aagttaaacatggaatagctatgtgactcagcaattccaaggtaagatgtaaaagaattgaaaagaagcattcaaacaaatacttctacacaaatgttcacagcagcagcagcagcactatttgtaataaccaaaaggtagaaacaagccaagtgttcatcaactgatgagtaggtaaacaaaatgtggtctatccatacaatggaatgttattgtatgaagtgctgatacatgctgtgacatggatcagccttgaaagtatgatgctaaatgaaagacaccagacacgaaagtcacgtgttgtatgatgccatttctatggaatgtccagcataggcaagtccacagatacagagtaaactggtggttttcaaggcctggagagagacggagtggctgcttaatagtatgaagagagggatacactggctcacagtgccccacttttaactgaaaaaaccttcaacaagcttgtgggaaagtttagccagtccatctttcacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagccatcctgggagccaggcaccaatattatccccatcagacacatcaagaagctaa

SEQ ID NO: 6743 - DNA, 1536 bp, Artificial Sequence
  Synthetic polypeptide
agaaaaagaagctgtgaaaagagaaaagcgagaggaaaagtagaagaaaaagaaataaggaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaagatcacacagctgaagatcgacaacaacccgtttgccaagggcttccgggacaccgggaacggccggcgggagaaaaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgagctgaggagaagtcgtgcgccgcggacagcgacccggagcctgagcggttgagcgaggagcgtgcgggggcgccgctaggccgcagcccggctccagacagcgccagccccactcgcttgaccgaacccgagcgcgcccgggagcggcgtagtcccgagaggggcaaggagccggccgagagcggcggggacggcccgttcggcctgaggagcctggagaaggagcgcgccgaagctcggaggaaggacgaggggcgcaaggaggcggccgagggcaaggagcagggcctggcgccgctggtggtgcagacagacagtgcgtcccccctgggcgccggacacctgcccggcctggccttttccagccacttgcacgggcagcagttctttgggccgctgggagccggccagccgctcttcctgcaccctggacagttcaccatgggccctggcgccttctccgccatgggcatgggtcacctactggcctcggtggcaggcggcggcaacggcggaggtggcgggcctgggaccgccgcggggctggacgcaggcgggctgggtcccgcggccagcgcagcaagcaccgccgcgcccttcccgttccacctctcccagcacatgctggcatctcagggaattccaatgcccactttcggaggcctcttcccctacccctacacctacatggcagcagcagccgcagccgcctcggctttgcccgccactagtgctgcagctgccgccgccgcagccgccggctccctctcccggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtga

SEQ ID NO: 6744 - DNA, 748 bp, Artificial Sequence
  Synthetic polypeptide
tgatacggtttggctgtgtccgcactcaaatctcatgctgaattgcagttcccattatccctatgtgtcctgggaaggacccggagggaggtagttgaatcaagggggcggttaccctcatgcggttctcgtgatagcaagtgagttctcacgagatctgatggttttatagaggctttcccctccttccctctgcacttctcgctgctgccacgtcgcaaaggaagtgttttcttctccttccgccatgattataaatttcctgaggcctccccagccctgcggaactaagaggaagagacaccagagatgtgcacactcagagacaagacacatgaggacacagagacaaggcggctacctgcaagccagggagaggggcctcggggaagccaaccctgcctacgccttgatcttggacttccagcctccagaactccagaatctgagtgaaatgggtataaatcatgagctaggatacagttcaattattcctatgatgaaaagagctttctccgcatgtgggactctcggcctcattatgagtggcatctttgacaatccagggcccattaaaaacaccttgaagaaagcattcaccatgctgtggagcttcacagtctataccaggctggaatccttgagggtggcattatcaaatgaggaaatggttcctttcatttttcatctgaagactcagacagcaaacatgttatctggccctataagcaccccgatgcttctgtga

SEQ ID NO: 6745 - DNA, 665 bp, Artificial Sequence
  Synthetic polypeptide
tgctaaggaatgaatgtttgtgccctccttgtccccaaattcagatgctgaagccccaattctcaatacgatggtatttggaaatggggcttttgagaaggaagtatggttagataatgttatgagggtggggcctaggtctgatgggattagtggcgttataagcagagacatcagagaactcgttctctctctccccacccacaggcactggggaagggccacatgaccacacagtgaaaaggtggctgcctacaagctgagagatgaggcctcggaatgaaacctgcctggctagtgttttgatcttggattttcctgcctccagaacagaaaataaatttctgttgtttaagtcctggtctacggaattttgctatggtgtagggagtgaagtctcagataagaggacctgtgtgagcctcactacccagcgactgccggttagcagaatcaagacctacaccatcacggaaggctccttgagagcagtaatttttattaccaaacgtggcctaaaagtctgtgctgatccacaagccacatgggtgagagacgtggtcaggagcatggacaggaaatccaacaccagaaataacatgatccagaccaagccaacaggaacccagcaatcgaccaatacagctgtgactctgactggctag

SEQ ID NO: 6746 - DNA, 750 bp, Artificial Sequence; identical to SEQ ID NO: 489
  Synthetic polypeptide

SEQ ID NO: 6747 - DNA, 387 bp, Artificial Sequence
  Synthetic polypeptide
cactcttacttgtctttttgatgacgtgtctgtctccccaccagacctgggagcgtctcgagggcagggtccgggtctgactcgtctctatgtcccccacgcccggcccagggctggccacagacaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggtga

SEQ ID NO: 6748 - DNA, 408 bp, Artificial Sequence
  Synthetic polypeptide
cactcttacttgtctttttgatgacgtgtctgtctccccaccagacctgggagcgtctcgagggcagggtccgggtctgactcgtctctatgtcccccacgcccggcccagggctggccacagacaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactga

SEQ ID NO: 6749 - DNA, 360 bp, Artificial Sequence
  Synthetic polypeptide
cactcttacttgtctttttgatgacgtgtctgtctccccaccagacctgggagcgtctcgagggcagggtccgggtctgactcgtctctatgtcccccacgcccggcccagggctggccacagacaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccat

SEQ ID NO: 6750 - DNA, 334 bp, Artificial Sequence
  Synthetic polypeptide
cactcttacttgtctttttgatgacgtgtctgtctccccaccagacctgggagcgtctcgagggcagggtccgggtctgactcgtctctatgtcccccacgcccggcccagggctggccacagacaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttga

SEQ ID NO: 6751 - DNA, 237 bp, Artificial Sequence
  Synthetic polypeptide
cactcttacttgtctttttgatgacgtgtctgtctccccaccagacctgggagcgtctcgagggcagggtccgggtctgactcgtctctatgtcccccacgcccggcccagggctggccacagacaatggtggatgtgatctttgctgatgtggcccagccagaccagacccggattgtggccctgaatgcccacaccttcctgcgtaatggaggacactttgtgatttccattaag

SEQ ID NO: 6752 - DNA, 2120 bp, Artificial Sequence
  Synthetic polypeptide
tctccctctccctctccccatggtctccctctccctctccccacggtctccctctccctctctttccacggtctccctctcatgctgagccgaagctggactgtactgctgccatctcggctcactgcaacctccctgcctgattctcctgactcagcctgccgagtacctgcgattgcaggctggcgccgccacgcctgactggttttggtggagaccgggtttcgctatgttggccaggccggtctccaacccctaactgcaagtgatccgccagcctcggcctcccgaggtgcggggattgcagacggagtctcgttcactcagtgctcaatggtgcccaggctggagtgcagtggcgtgatctcggctcgctacaacctccacctcccagccgcctgccttggcctcccaaagtgccgagattgcagaaagattgcagcctctgcccggccaccaccccgtctgggaagtgaggagcgtctctgcctggccgcccatcatctgggatgtgaggagcccctctgcctggctgcccagtctggaaagtgaggagcgtctccgcccggccgccatcccacctaggaagtgaggagcacctcttcccggccgccatcacatctaggaagtgaggagcgtctctgcccggccgcccatcgtctgagatgtggggagcgcctctgccctgccgccccgtctgggatgtgaggagcacctctgcccggccgcgaccctgtctgggaggaaacttcatggtgttatggtcaacttgccgcacaaccgtgttcaaatctgtcaccaacaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctag

SEQ ID NO: 6753 - DNA, 2725 bp, Artificial Sequence
  Synthetic polypeptide
tttggtgccgtgactcagatcaggggacctcccttgggagataaatcccctgtcctcctgctctttgctctgtgagaaagatccacctacgacctcaggtcctcagaccgaccagcccaagaaacatctcaccaatttcaaatctggtaagtggcctctttttactctcttctccagcttccctcactatccctcaacctctttctcctttcaatcttggcgccacacttcaatctctcccttctcttaatttcaattcctttcattttctggtagagagagacaaaagagacacgttttatccatggacccaaaactccggtgctggtcacggactgggaaggcagccttcccttggtgtttaatcattgcagagatgcctgattattcacccacgtttcaaaggtgtcagaccacgcagggacgcctgccttggtccttcacccttagcagcaagtcccgcttttctggggaagaggcaagtaccccaatcccttctctccttgtctctaccccttctctgcttttctgggggagggacaagtacccctcaactgcttctccttcacccttagcggcaagtcccgcttttctagggggcaagaacccccaatcccttatttccacaccccaacctcttatctctgtgccccaattccttatttccatgccccaaccctttctctgcttttctggagggcaagaaacccccaccccttctccgtgtctctactcttttctctggacttgcctccttcactatgggcaagcttccaccttccattcctccttcttctcccttagcctatattcttaagaacttaaaacctcttcaactctcacctgacctaaaatctgagcatcttattttcttctgcaatgcgcttgaccccaatacaaactcgacagtagttccaaatagccggaaaatggcactttgaatttttccatcctacaagatctaaataatccttgtcataaaatgggcaaatggtctgaggtgcctgacgtccaggcattcttttacacatcagtcccttcctagtctctgtgcccagtgcaactcgtcccaaatcttccttctttcccccctccgcctgtcccctcagtcccaaccccaagcgttgctgagtctttctaatcttccttttctacagacccatctgacccctcccctcctcgccaggccaagctaggtcccaattcttcctcagcctccgctcctctaccctgtaatctttttatcgcctcccctcctcacacctggtccggcttacagtttctttctgtgactagccctcccccacctgcccagcaatttactcttaaaaaggtggctggagccaaaggcatagtcaaggttaatgctcctttttctttatcccaaatcagaagcgtttaggctcttttttatcaaatataaaaacccagcccagttcatggctcgttcggcagcaatcctgagacgttttacagccctagaccctaaaaggtcaaaaggccatcttattctcaatatacattttattacccaatctgctcctgacattaaataaaactccaaaaattagaatctggccctcaaaccccacaacaggacttaattaacctcaccttcaaggtgtacaataataaaaaaaaaaattgcaattccttgcctccactgtgagacaaaccccagccacatctccagcacacaagaacttccaaacgcctgaaccgcagcggccaggcgttcctccagaacctcctcccccaggagcttgctacaagtgccagaaatctgaccaccaggccaaggaatgcctgcagcccaggattcctcctaagccatgtcccatctgtgcgggaccacactggaaatcggactgttcaactcacctggcagccactcccagagcccctggaactctggcccaaggctctctgactgactccttcttggcttagcggctgaagattgatgctgcctcattgcctcagaagccccatagaccatcacggacgccaagcttccggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactag

SEQ ID NO: 6754 - DNA, 426 bp, Artificial Sequence
  Synthetic polypeptide
cactttagaaggctgaggcaagtggatcacttgagttgtcctgctgtccatgctatgcctggtattggcccattggcccaaacgcctgttctctggagagctgatctacatcgcagcggctgtgttgctgctggtgctcattgtgggattcactttcaccgtctggagacagccccagagcaacactcctctttacttcaaggtccccctgttgcctgttctcctctggtcagcatctctgcacatgtttacctgatgatgcagatgaccactgagacctgggcccaatgtggagtctggatgttgattggatttgctatgtattttggatatgggatcccacacagcttggagaacaatcaacagccaccagcgtcaagctcccaaactcctcatgaaaacatccctagtcccttgctgaattag

SEQ ID NO: 6755 - DNA, 1286 bp, Artificial Sequence
  Synthetic polypeptide
attagattgtctctaggtaattggagactttaataagggctgtggtaggtgttggaagcatctactggaacaatttccagatcaaagtgaactttgctgtgctgctggggatgcagctgcaagccttcatcatcatgtgtttttctgtgggtgcagacctggactctcctgaggaaaccccagcccggccccagacactccttggcctcctcctggggcctgtttaagctgctcagttttcatgagccagctctcagatctggctcgagaccaccatggctaaggtggaaggggctgccgcccagcttcccagcctcaacaaccgactcagctatgctgtccgcaaggtccacaccattcggggcctgattgctcgaaagcttgcccttgctcagctgcgccaggagagctgtcccctaccaccaccggtcacagacgtgagccttgagttgcagcagttgcgggaagaacggaaccgcctggatgcagaactgcagctgagtgcccgcctcatccagcaggaggtgggccgggctcgggagcaaggggaggcagagcggcagcagctgagcaaggtggcccagcagctggagcaggagctgcagcagacccaggagtccctggctagcttggggctgcagctggaggtagcacgccagggccagcaggagagcacagaggaggctgccagtctgcggcaggagctgacccagcagcaggaactctacgggcaagccctgcaagaaaaggtggctgaagtggaaactcggctgcgggagcaactctcagacacagagaggaggctgaacgaggctcggagggagcatgccaaggccgtggtctccttacgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaagggtccctctctgtcctgctcgatgacctgcaggacctgagtgaagccatttccaaagaggaagctgtttgtcaaggagacaaccttgacagatgctccagctccaatccccagatgagcagctaa

SEQ ID NO: 6756 - DNA, 503 bp, Artificial Sequence; identical to SEQ ID NO: 493
  Synthetic polypeptide

SEQ ID NO: 6757 - DNA, 476 bp, Artificial Sequence; identical to SEQ ID NO: 495
  Synthetic polypeptide

SEQ ID NO: 6758 - DNA, 539 bp, Artificial Sequence; identical to SEQ ID NO: 496
  Synthetic polypeptide

SEQ ID NO: 6759 - DNA, 206 bp, Artificial Sequence
  Synthetic polypeptide
gggggaggagccaagatggccgaataggaacagctccggtctacagctcccagcgtgagcagaagacggcgatttctgcatttccatctgagacaaagactacaagaatttcaacagtaacagcaacaacagcaacaacaactttgatgatgactactgcttcgatgtcttcgatggctcctacccccgtttctcccactggttga

SEQ ID NO: 6760 - DNA, 1443 bp, Artificial Sequence
  Synthetic polypeptide
ggcctgggaggggcccggccggcggggctgagcctgtgcgtcctggggtgaggcctgggaggggcccggccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtga

SEQ ID NO: 6761 - DNA, 984 bp, Artificial Sequence
  Synthetic polypeptide
ggcctgggaggggcccggccggcggggctgagcctgtgcgtcctggggtgaggcctgggaggggcccggccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggccgctga

SEQ ID NO: 6762 - DNA, 1032 bp, Artificial Sequence
  Synthetic polypeptide
ggcctgggaggggcccggccggcggggctgagcctgtgcgtcctggggtgaggcctgggaggggcccggccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgagtgcgcgcgcaggatgaagaagtgcatcaggtgccaggtggtcgtcagcaagaaactgcgcccagacggctctga

SEQ ID NO: 6763 - DNA, 1636 bp, Artificial Sequence; identical to SEQ ID NO: 531
  Synthetic polypeptide

SEQ ID NO: 6764 - DNA, 835 bp, Artificial Sequence
  Synthetic polypeptide
tgactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaattgaccggaggggatttgtgcagtccgacaccgtgttgccctcacccatcagaagcgatgagccagcctgcagagccaagcctgatgccagcatggtaggaggccacccctga

SEQ ID NO: 6765 - DNA, 839 bp, Artificial Sequence
  Synthetic polypeptide
tgcagtcagtagaatgatggccccacagatgtccacatctcactggctggaacctgtgaatatgttgggttgtatggcaaaggaaactaaggctgcagatggaactaaggttatttacctttagtgaattccatcttctgaaaacaatgcttttgtgggtcttcttgcaactgaactacaagattcaggcaattccgacttatgaaaccgtgatgacattttttaagagctttcctgagaactgttgctttctggaccgggacataggacggagcttgaggccgctcttcctctgcttgcgtctgcacggcatcaccaaaggcaaggatctggaggtgctgcggcaccttaacttcttcccagagtcatggctcgaccaggttacagtcaaccattaccacgcactggagaatgggggcgacatggtccacctgaaagatcttaacacccaggctgtgagatttgggctgctctttaaccaggagaatacaacttattcgaaaacgattgctctatatggattcttctttaagataaagggactcaaacatgatactacctcttatagtttttacatgcagagaataaagcacacagacctggaatctccctctgcggtctacgagcacaaccacgtcagcctgcgagcggcacgcctggtgaagtatgagatcagagcagaggccctggttgacggcaagtggcaggagttcaggacaaaccagatcaagcagaagtttgggttgaccacgtcatcctgcaaaagccataccttgaaaatccaaactgtgggcatcccaatctatgtaagttttgcattcatcttcccagcatcttga

SEQ ID NO: 6766 - DNA, 226 bp, Artificial Sequence
  Synthetic polypeptide
ccatcaccaagcggtgagactatcacctatcgccaagtggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 6767 - DNA, 394 bp, Artificial Sequence
  Synthetic polypeptide
ccatcaccaagcggtgagactatcacctatcgccaagtggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6768 - DNA, 454 bp, Artificial Sequence
  Synthetic polypeptide
ccatcaccaagcggtgagactatcacctatcgccaagtggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctga

SEQ ID NO: 6769 - DNA, 346 bp, Artificial Sequence
  Synthetic polypeptide
ccatcaccaagcggtgagactatcacctatcgccaagtggaggggtgctgtcatcctggtctcttccattgcagcttataatccagtagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctga

SEQ ID NO: 6770 - DNA, 337 bp, Artificial Sequence
  Synthetic polypeptide
ccatcaccaagcggtgagactatcacctatcgccaagtggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttga

SEQ ID NO: 6771 - DNA, 1328 bp, Artificial Sequence; identical to SEQ ID NO: 532
  Synthetic polypeptide

SEQ ID NO: 6772 - DNA, 7501 bp, Artificial Sequence; identical to SEQ ID NO: 557
  Synthetic polypeptide

SEQ ID NO: 6773 - DNA, 7492 bp, Artificial Sequence; identical to SEQ ID NO: 558
  Synthetic polypeptide

SEQ ID NO: 6774 - DNA, 373 bp, Artificial Sequence; identical to SEQ ID NO: 559
  Synthetic polypeptide

SEQ ID NO: 6775 - DNA, 337 bp, Artificial Sequence; identical to SEQ ID NO: 560
  Synthetic polypeptide

SEQ ID NO: 6776 - DNA, 301 bp, Artificial Sequence; identical to SEQ ID NO: 561
  Synthetic polypeptide

SEQ ID NO: 6777 - DNA, 373 bp, Artificial Sequence; identical to SEQ ID NO: 562
  Synthetic polypeptide

SEQ ID NO: 6778 - DNA, 442 bp, Artificial Sequence; identical to SEQ ID NO: 563
  Synthetic polypeptide

SEQ ID NO: 6779 - DNA, 1276 bp, Artificial Sequence; identical to SEQ ID NO: 565
  Synthetic polypeptide

SEQ ID NO: 6780 - DNA, 7528 bp, Artificial Sequence; identical to SEQ ID NO: 566
  Synthetic polypeptide

SEQ ID NO: 6781 - DNA, 418 bp, Artificial Sequence; identical to SEQ ID NO: 567
  Synthetic polypeptide

SEQ ID NO: 6782 - DNA, 1392 bp, Artificial Sequence
  Synthetic polypeptide
ggcctgggaggggcccggccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtga

SEQ ID NO: 6783 - DNA, 933 bp, Artificial Sequence
  Synthetic polypeptide
ggcctgggaggggcccggccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggccgctga

SEQ ID NO: 6784 - DNA, 981 bp, Artificial Sequence
  Synthetic polypeptide
ggcctgggaggggcccggccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgagtgcgcgcgcaggatgaagaagtgcatcaggtgccaggtggtcgtcagcaagaaactgcgcccagacggctctga

SEQ ID NO: 6785 - DNA, 1922 bp, Artificial Sequence
  Synthetic polypeptide
cactggggtattgtcagcgcctagtaaagcacttggcatacagagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtga

SEQ ID NO: 6786 - DNA, 1997 bp, Artificial Sequence
  Synthetic polypeptide
cactggggtattgtcagcgcctagtaaagcacttggcatacagagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcgaaaaccctgcccttcacaccagatatcctcgttggggtcccactgtggcatcatcagaagatagggggtagtccggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtga

SEQ ID NO: 6787 - DNA, 568 bp, Artificial Sequence
  Synthetic polypeptide
caacatgaagcctgacacattatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtga

SEQ ID NO: 6788 - DNA, 181 bp, Artificial Sequence
  Synthetic polypeptide
caacatgaagcctgacacattatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccacaagtaa

SEQ ID NO: 6789 - DNA, 367 bp, Artificial Sequence; identical to SEQ ID NO: 548
  Synthetic polypeptide

SEQ ID NO: 6790 - DNA, 398 bp, Artificial Sequence
  Synthetic polypeptide
ggccaggcaccgtggctcacacctgtaacccaagcactttgggaggccgaggcaggaggattgcttgagtccaggagttcaagaccagcctgagcaacatagcgaaacctcactgctacaaaaaagaagagagaaaaaaaaaaaaggctgggcatggtgtcatgtgcctgtagtcccagctgcctgggaggctgagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctga

SEQ ID NO: 6791 - DNA, 391 bp, Artificial Sequence
  Synthetic polypeptide
ggccaggcaccgtggctcacacctgtaacccaagcactttgggaggccgaggcaggaggattgcttgagtccaggagttcaagaccagcctgagcaacatagcgaaacctcactgctacaaaaaagaagagagaaaaaaaaaaaaggctgggcatggtgtcatgtgcctgtagtcccagctgcctgggaggctgagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagc

SEQ ID NO: 6792 - DNA, 473 bp, Artificial Sequence
  Synthetic polypeptide
ggccaggcaccgtggctcacacctgtaacccaagcactttgggaggccgaggcaggaggattgcttgagtccaggagttcaagaccagcctgagcaacatagcgaaacctcactgctacaaaaaagaagagagaaaaaaaaaaaaggctgggcatggtgtcatgtgcctgtagtcccagctgcctgggaggctgagggctgaccagtttgagtatgtaatgtatggaaaagtgtacaggattgagggagatgaaacttctactgaagcagcaacacgcctgctgagattgagagctgctgagtggcagtgctccagaatcacgggatggggccttctgtttcagctctgcgtacgtgtcctatgggggcctgctcatgaggctgcagggggatgccaacaacctgcatggattcgaggtggactccagagtttatctcctgatgaagaagctagccttctgaacctcgcctga

SEQ ID NO: 6793 - DNA, 1197 bp, Artificial Sequence
  Synthetic polypeptide
gcctggctcggtagctcacgcctgtcatcccagtgctttgggagcccgaggcgggtggatcgcttgagtccaggagtttaagaccagaccgggtgacatggcgaaaccccatctctacaaaaaatacaaaaattagccaggcctggtgatgaaagtgaagaggatgaagatgatttgttgcaaaggactgggaatttcatatccacatcaacttctcttccaagaggaatcttgaagatgaagaactgccagcatgcgaatgctgaacgtcctactgttgctcggatctcatctgtgcagttccatcccggtgcacagattgtgatggttgctggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaagggcaaggccctgatgtataggttgcaccattactcagacttctaa

SEQ ID NO: 6794 - DNA, 708 bp, Artificial Sequence
  Synthetic polypeptide
gccaaatgtggttgctcacacctgtgatctgagcactttgggaggccaaggtgagaggatcgcttaagcctaggagttcaaaaccagcctcggcaacatgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtga

SEQ ID NO: 6795 - DNA, 1016 bp, Artificial Sequence
  Synthetic polypeptide
ttaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacggttgaagacctatgaaactaatttggaaatcaagaagctgttggaggaagtgaaagaaaagaatcccaagctgactattgattgcaatgcttccggggcaacggcacctccgtgctgtgactttttttgctga

SEQ ID NO: 6796 - DNA, 1187 bp, Artificial Sequence
  Synthetic polypeptide
ttaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacgcctctggagctgctccctcatgcctttctattgtcagcatcttggatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctga

SEQ ID NO: 6797 - DNA, 965 bp, Artificial Sequence
  Synthetic polypeptide
ttaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacgcatcttggatctgctctcctcagcaatcagaagcttgaaactctggacctgggccagaatcatttgtggaagagtggcataa

SEQ ID NO: 6798 - DNA, 784 bp, Artificial Sequence
  Synthetic polypeptide
agttcaaccttgtggggagccctgaccccaggagagaggcaacagggttcacaccccagccgggccacgtgacacaggacatatcatgagcgtcttgttgttcatcgagcactcagtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtga

SEQ ID NO: 6799 - DNA, 2287 bp, Artificial Sequence
  Synthetic polypeptide
ctgccatcccctttatctctcttagttaatgccacccacccacaccaggctgcctcctgttttagacttggatgaaaccacacaccatgaggtgtggtaccagcttcctgaggggccagatggtggagccagatgatgcaacctggaagtgtgcgcaagttaactcaccgtgggtgaaccttgaatgaagggaaatggaaaatgagaaggagataccagtttcattccaggacctgactgtgaacttcacccaagaggaatggcagcaactggaccctgctcagaggctcctgtacagggatgtgatgctggagaactacagcaacttggtctctgtggagtctctgatgtccaaagatcttggtccaagttctgtaatttcccattaacagggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaagtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataa

SEQ ID NO: 6800 - DNA, 2234 bp, Artificial Sequence
  Synthetic polypeptide
ctgccatcccctttatctctcttagttaatgccacccacccacaccaggctgcctcctgttttagacttggatgaaaccacacaccatgaggtgtggtaccagcttcctgaggggccagatggtggagccagatgatgcaacctggaagtgtgcgcaagttaactcaccgtgggtgaaccttgaatgaagggaaatggaaaatgagaaggagataccagtttcattccaggacctgactgtgaacttcacccaagaggaatggcagcaactggaccctgctcagaggctcctgtacagggatgtgatgctggagaactacagcaacttggtctctgtggggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaagtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataa

SEQ ID NO: 6801 - DNA, 1327 bp, Artificial Sequence
  Synthetic polypeptide
ctgatctatcgctacctgatgtcctttcctattgctttctgctttcactcacctggctctaataatatggattccttgcaacgtgacaggcacaaatctgactcctggcctttgcacttgctattcctttgtcctggattgctcttttcccagatatatgaatgtggtttactctgtcacctctctgaagtcctggctcaaatgtcatgttttaccttctcagggaggacttgcctggccaccgtgttgaagagactgtcctttcctacatagatgggctctccttccccaccgtctttctctccttagtgcttacgaccagccatcactctatatattatgcctttttgtcttgtttattgtttgtcctctttcccctccctgctacaccctcgaattaatgcacacagggcaggggcttttgtttggttcactcatagtcatgtgtccccagcagctagtttgttgcctggcatgaggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattga

SEQ ID NO: 6802 - DNA, 294 bp, Artificial Sequence
  Synthetic polypeptide
acagtgtttaaaaacaagagtttggccccagcctgctccagatctccccctcactaactgtgggatcctgggatcatctttgagcctcattttcctcacgggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtag

SEQ ID NO: 6803 - DNA, 132 bp, Artificial Sequence
  Synthetic polypeptide
ggccagtccctctccaagatcctggatgtggccagtttggaggtgctgaacgaggttaaccgaaggtccctgaagaagctggccagccaggccgactccacggagcaggtggacgacaccatcctgacatga

SEQ ID NO: 6804 - DNA, 625 bp, Artificial Sequence
  Synthetic polypeptide
aatatcacctgggagtgtgttggaaatggacaatctcagcgctcatcccagacctactgaatcagaatcagcactttaacacagtccctaagtgatgtaacacctggagaccgactccctggaccctgagaagctattgcaatgcccctatgacaaaaaccatcaaatcagggcttgcaggtttccttatcatcttatcaagtgcagaaagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaattcagattctcttgatttcagtctgtgctactgtttgagctaa

SEQ ID NO: 6805 - DNA, 598 bp, Artificial Sequence
  Synthetic polypeptide
aatatcacctgggagtgtgttggaaatggacaatctcagcgctcatcccagacctactgaatcagaatcagcactttaacacagtccctaagtgatgtaacacctggagaccgactccctggaccctgagaagctattgcaatgcccctatgacaaaaaccatcaaatcagggcttgcaggtttccttatcatcttatcaagtgcagaaagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaatggaaatgcacagtaa

SEQ ID NO: 6806 - DNA, 2534 bp, Artificial Sequence; identical to SEQ ID NO: 586
  Synthetic polypeptide

SEQ ID NO: 6807 - DNA, 1716 bp, Artificial Sequence
  Synthetic polypeptide
tagtaggtaagagtggactctggagccagcttgtctccctctggatcctagctctgctgcttactagctgtgttattttgggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttga

SEQ ID NO: 6808 - DNA, 379 bp, Artificial Sequence
  Synthetic polypeptide
ctcaagaccttctcatggcttttagtgcaaagtccaaattcttcaggcctttgccaaccccgaggatgccctgagacacggaggcccccagtattgcaggagcgaccccgacgtggaacgctgcctcagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctgtga

SEQ ID NO: 6809 - DNA, 586 bp, Artificial Sequence
  Synthetic polypeptide
ggctgggcatatggtggctcacgcctggaatcctagcacttggagaggctgaaacggcatcacttgagcccaggagtttgagatcagcctagggaacatagcaagactccattgctacaaaaaaataaaataaaataagtagctggtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaa

SEQ ID NO: 6810 - DNA, 1571 bp, Artificial Sequence
  Synthetic polypeptide
ccagacataaggagggaactgataagcctaaatggtaaattgaagaaggtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtga

SEQ ID NO: 6811 - DNA, 382 bp, Artificial Sequence; identical to SEQ ID NO: 434
  Synthetic polypeptide

SEQ ID NO: 6812 - DNA, 1828 bp, Artificial Sequence
  Synthetic polypeptide
tgatatgtttggatttgtgtccccacctaaatctcatgatgaattgtaattcccaatgttgggggagggacctggtgggaggtgattggatcttggcggtggttttcccccttgctgttcttgtgacagtgagtgagttctcatgagatctgatggtttaaaagtgtgtggcacttccccattcactcactgtctctcctgccgtcacgtgaagatgtgcttgcttcccctttgcccttccaccgtaattgtgagtttcctgaggcctcaccagccatgcctcctgtacagcctgtggaactcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctga

SEQ ID NO: 6813 - DNA, 404 bp, Artificial Sequence
  Synthetic polypeptide
gctgggtggccttgagcaagccacttggcagctctgggccgcagttccgtcatctgcaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccac

SEQ ID NO: 6814 - DNA, 417 bp, Artificial Sequence
  Synthetic polypeptide
gctgggtggccttgagcaagccacttggcagctctgggccgcagttccgtcatctgcaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaac

SEQ ID NO: 6815 - DNA, 485 bp, Artificial Sequence
  Synthetic polypeptide
gctgggtggccttgagcaagccacttggcagctctgggccgcagttccgtcatctgcaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccc

SEQ ID NO: 6816 - DNA, 1745 bp, Artificial Sequence
  Synthetic polypeptide
gctgggtggccttgagcaagccacttggcagctctgggccgcagttccgtcatctgcaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtag

SEQ ID NO: 6817 - DNA, 100 bp, Artificial Sequence
  Synthetic polypeptide
ctgggtatgaatcaaggatcctttacttagtagttaactagaagactgggactagttaatttctccagtgctcagcttcttatctacaggtatctgctga

SEQ ID NO: 6818 - DNA, 769 bp, Artificial Sequence; identical to SEQ ID NO: 6486
  Synthetic polypeptide

SEQ ID NO: 6819 - DNA, 1216 bp, Artificial Sequence
  Synthetic polypeptide
cggcgtcggcggccgcggccggggacggtgtgagagcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggaggtcgagctgtgtttagagtgcatcgaatgggccaagtcagagaaaagaactttcttacgccaagctttggaggcaagactggtgtctttgtactttgataccaagaggtaccaggaagcattgcatttgggttctcagctgctgcgggagttgaaaaagatggacgacaaagctcttttggtggaagtacagcttttagaaagcaaaacataccatgccctgagcaacctgccgaaagcccgagctgccttaacttctgctcgaaccacagcaaatgccatctactgcccccctaaattgcaggccaccttggacatgcagtcgggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacaccccagaagatgtccaggctttggtgagcgggaagcttgcacttcggtatgcagggaggcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacagattgaacacatatctagtctcatcaaactctccaaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacatag

SEQ ID NO: 6820 - DNA, 510 bp, Artificial Sequence
  Synthetic polypeptide
cggcgtcggcggccgcggccggggacggtgtgagagcgtgaagcgtgacattcaggaaaacgatgaagaggcagtgcaagtcaaagagcagagcatcctggaactgggatctctcctggcaaagactggacaagctgcagagcttggaggactcctgaagtatgtacgacccttcttgaattccatcagcaaggctaaagcagctcgcctggtccgatctcttcttgatctgtttcttgatatggaagcagctacagggcaggagtttctctttgttacagggcatttgatactttgggtctgttccatgctttgctttgtaagtggagattgtcagtggtccctggaatcctcattacatcagggtcacaaactgattcttgtctttgaggtcgagctgtgtttagagtgcatcgaatgggccaagtcagagaaaagaactttcttacgccaagctttggaggcaagactggtgtctttgtactttgataccaagaggtaccaggaagc

SEQ ID NO: 6821 - DNA, 2816 bp, Artificial Sequence
  Synthetic polypeptide
ggttttttttttttttttttttttttttacaaattgagggtttgtggcagccctgaattgagcaagtttacgggcaccatttttccaaaagcatctccttcctttgtgtctctatataacattttggtaattcttgtggtatttcaaacttttcattactataacatctggtatggtcatctgtgatcagtgacctctgacgttactgttataattatttggggtaccgtgaagtgcacacatgtaagacagcaaacttaattggtaaatattatgtatattctggctgctctactaatcaatcatcctctagtctctttccgtctcctctggtctccctactccctaaggcacagcagtattgaaattaggtcaattaataaccctaccatggcttccaagtgttcaagtagaaggaagagttgcatgtgtatcactttacataaaaatgattaagcttagttcggaaggcatggttgaaagccaagataggccaaaagctaggcctcttgcaccaaacagttagctaaattttaaaatgcaaaggacacattcttgaaggaaattaaaagtgctgttccagtgaatacatcaaaggtaagcaagcaaaacaaccttattgctgatatggagaaagtttgagtagtctggatagaagatcaaatcagccacaacattctcttgagccaaagcctaatccagagcaatgccctctctctcttcattctaagaaggccaagagaagtgaggaagctgcagaagaaaagttggaagctagcagaggttggttcattaggcttaaggaaaacagctgtctccataacataaaagtacagtgtgcagcagcaagtgctatggagaagctgcagcaagttatccagaggatctagccaagatcattgatgaaggtggctacaccaaccagtagattttcaatgtaaatgaaacagccttctgctggaaaaagataacatctaggactttcatggctagagaggggaagaagttgatgcctggcttcaaagcttcaaaagacaggcttactttctcgtcagggaataatgcagctggtaactttaagttgaagccagtgctcatttatcattctgaaaatcctagggtactcaagaattatgctaaatccattctatctgtgctctataaatggaacaataaagcctggatgacagcacatctgtttacggcatggtttactgaagccctatgtggagacttactgctcagtaaaaaaatatttttttcaaaatattactgctgattgacagtgtacctagtcacccaagagctctgagggagatatgaaaggagatgaacattgtctatatgcccataccacaacatccattctgcaacccatgaatcaaggagcccttccaacttaagttttattatttaagacatatattttataaggctgtaggtgccatagagagtgattcctctgatggatctgggcaaagtaaattgaaaactttctgggaaggatttactattctagatgccattacaaacattcatgattgatgggaagaggtcaaaatattgacattaacaggagattagaagaagtttattctaatcctcatggatgactttgggttcaagatttcattggaggaaataactgctgatatggtgtgaatagcaagagaactagaattagaagtggagcctgaagatgtgactgaattgctgcaatcccatggtcaaacttgaagagataaggagttgtttcttatgggtgaacaaagaaagtggttcttgagatggaatctattcctggtgaagatgctgtgaaagttgttgaaatgacaacaaaggattgagaatattctgtaagcttcactgataaaggaactagcagggttggagatggtaaaatgctatcaagcagcatcacatgctacagagaaatattttgtgaaaggaagacttaatgcatcaaacttcattgttgtcttattttaggaaattgtcacagacaccccaacctttaccaaccaccaccccagtgagtcagcagccactaacatgaatgcaagaccctctaccaatagaaagattatgacttgttgaaagactcagatggttattaatacgttttagcggcacctgaatggacagaagaggacctcagccaactgacaagaagtatggttaagttcccaggagggactccaggtcgatgggaaaagattgcccacgaattgggtcgatctgtgacagatgtgacaaccaaagccaagcaactgaaggattcagtgacctgctccccaggaatggttagactctccgaactcaaatcgacagttcagaattccaggcccatcaaaacggccaccaccttgcccgatgacatgatcacccagcgagaggacgcagagggggtggcagcggaggaggagcaggagggagactccggtgagcaggagaccggggccactgatgcccggcctcggaggcggaagccagccaggctgctggaggctacagcgaagccggagccagaggagaagtccagagccaagcggcagaaggactttgacatagcagaacaaaacgagtccagcgacgaggagagcctgagaaaagagagagctcggtctgcagaggagccgtggactcaaaatcaacagaaacttctggaactggcgttgcagcagtacccaaggggatcctctgaccgctgggacaaaatagccagatgtgtcccgtccaagagcaaggaagactgtatcgctaggtacaagttgctggttgaactggtccaaaagaaaaaacaagctaaaagctga

SEQ ID NO: 6822 - DNA, 3057 bp, Artificial Sequence
  Synthetic polypeptide
gcactgccactgctagccgtggccacgacagttccctgtgcctcagagcctcattttcttcatctgcgaggtgcagatagtgcacccctatgaagctgtgggaccttcttgtgtgagacgcctgtgttagcaatgcatgaagaaaacgtttacacggtggagtcaaaccgagttcaagttcgaacctggcaggggactgtcaaacaactcctccttttctcggagactgaggggaatccctgcttcttggacatctgtgggaatttcctggttgtagggacagacttggctcactttaaaagctttgatctttcccgaagagaggccaaagcacactgtagctgcaggagcctggcggagctggtccctggggtggggggcatcgcttctctgcggtgcagcagcagcgggagcaccatcagcatcctccccagcaaggctgacaacagccctgattccaaaatctgcttctacgatgttgaaatggacacagtgaccgtctttgacttcaagactggacaaattgatcggagagagacgctgtcctttaatgagcaagagactaataagagccacctctttgtggatgagggactgaaaaattatgttcccgtgaaccacttctgggaccagagtgagccccggctgtttgtatgcgaagccgtgcaggagacgccgcgctcccagcctcagtctgcaaacgggcagccccaagatgggcgcgctggccctgcggcagatgttttgatcctgtccttcttcatttccgaagagcacggcttcctgcttcatgagagcttcccccggcctgccacctcccacagtctcctggggatggaagtgccttattactacttcacaagaaagcccgaagaagcagacagagaagacgaggtggagcctgggtgccaccacatccctcagatggtgtccaggagacccctgcgagactttgtggggctggaggactgcgacaaggccacccgggacgccatgctccacttcagcttctttgtcaccataggagacatggacgaagccttcaaatccatcaagctcatcaaaagtgaggccgtctgggagaacatggcgcgcatgtgcgtgaagacccagcggctggacgtggccaaggtgtgcctggggaacatgggccatgcccgcggggcccgagcgctgcgtgaggcggagcaggagccggagctagaggcccgcgtggccgtgctggccacgcagctgggcatgctggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcacctggaggccagcgccgactgcagccgggccctcagttactacgagaagtcggacacgcaccgcttcgaggtgcccaggatgctgtcggaggacctgccgtccctggagctctacgtgaataaaatgaaggataagaccctgtggcggtggtgggcgcagtacctggagagccagggcgagatggacgccgcgctgcactactacgagctggcccgggaccacttctccctggtccgcatccactgcttccagggcaatgtccagaaggctgcgcaaatagccaacgagacaggaaacctggcggcctcctaccacctcgcccgccagtacgagagccaggaggaggtcgggcaggcggtgcacttctacacccgggcacaggccttcaagaatgccatccgcctgtgcaaggagaacggcctggacgaccagctcatgaacttggccctgctgagctcccccgaggacatgatcgaggcggcccgatactacgaggagaagggcgtgcagatggacagggcggtcatgctgtaccacaaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgccaggaagtatcaggaagccctgcagctgtgcctggggcagaacatgagcatcaccgaggagatggcggaaaagatgaccgtggccaaggactcctcggacctgcctgaggagtcgcggcgggagctgctggagcagatagcagactgctgcatgcgccagggcagctaccacctggccaccaagaagtacacgcaggccggcaacaagctgaaggccatgagggcgctgctcaaatccggagacacggagaaaatcacgttcttcgcgagcgtgtccaggcagaaggaaatctacatcatggctgctaactacctgcagtccctggactggcggaaggagccggagatcatgaagaacatcatcggcttctacaccaaggggcgggccctggacctcctggctggcttttatgacgcttgtgcccaggtggagattgatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggacgtacacagaggaccccaaggagtccatcaagcagtgtgagctgctcctggaggaaccagacctggacagcaccatccgcatcggggacgtctatggcttcctggtggagcactacgtgcggaaggaggaataccagacggcctacagattcctggaggagatgcggcggcggcttcccttggccaacatgtcctactacgtgagcccgcaggccgtggacgccgtgcaccgggggctgggtctcccactgccacgcaccgtccccgagcaggtccgccacaacagcatggaggacgccagggagctggacgaggaggtggtggaagaggcagatgacgacccctga

SEQ ID NO: 6823 - DNA, 116 bp, Artificial Sequence
  Synthetic polypeptide
gcactgccactgctagccgtggccacgacagttccctgtgcctcagagcctcattttcttcatctgcgaggtgcagatagtgcacccctatgaagctgtgggaccttcttgtgtga

SEQ ID NO: 6824 - DNA, 1999 bp, Artificial Sequence
  Synthetic polypeptide
ggccatgaatattgtcacttcagtgctgctgctttatgccaaagaggaggaagctttctggctgcttgtggctttgtgtgagcgcatgctcccagattactacaacaccagagttgtgggtgcactggtggaccaaggtgtctttgaggagctagcacgagactacgtcccacagctgtacgactgcatgcaagacctgggcgtgatttccaccatctccctgtcttggttcctcacactatttctcagtgtgatgccttttgagagtgcagttgtggttgttgactgtttcttctatgaaggaattaaagtgatattccagttggccctagctgtgctggatgcaaatgtggacaaactgttgaactgcaaggatgatggggaggccatgaccgttttgggaaggtatttagacagtgtgaccaataaagacagcacactgcctcccattcctcacctccactccttgctcagcgatgatgtggaaccttaccctgaggtagacatctttagactcatcagaacttcctacgagaaattcggaactatccgggcagatttgattgaacagatgagattcaaacagagactgaaagtgatccagacgctggaggatactacgaaacgcaacgtggtacgaaccattgtgacagaaacttcctttaccattgatgagctggaagaactttatgctcttttcaaggcagaacatctcaccagctgctactggggcgggagcagcaacgcgctggaccggcatgaccccagcctgccctacctggaacagtatcgcattgacttcgagcagttcaagggaatgtttgctcttctctttccttgggcatgtggaactcactctgacgttctggcctcccgcttgttccagttattagatgaaaatggagactctttgattaacttccgggagtttgtctctgggctaagtgctgcatgccatggggacctcacagagaagctcaaactcctgtacaaaatgcacgtcttgcctgagccatcctctgatcaagatgaaccagattctgcttttgaagcaactcagtacttctttgaagatattaccccagaatgtacacatgttgttggattggatagcagaagcaaacagggtgcagatgatggctttgttacggtgagcctaaagccagacaaagggaagagagcaaattcccaagaaaatcgtaattatttgagactgtggactccagaaaataaatctaagtcaaagaatgcaaaggatttacccaaattaaatcaggggcagttcattgaactgtgtaagacaatgtataacatgttcagcgaagaccccaatgagcaggagctgtaccacgccacggcagcagtgaccagcctcctgctggagattggggaggtcggcaagttgttcgtggcccagcctgcaaaggagggcgggagcggaggcagtgggccgtcctgccaccagggcatcccaggcgtgctcttccccaagaaagggccaggccagccttacgtggtggagtctgttgagcccctgccggccagcctggcccccgacagcgaggaacactcccttggaggacaaatggaggacatcaagctggaggactcctcgccccgggacaacggggcctgctcctccatgctgatctctgacgacgacaccaaggacgacagctccatgtcctcatactcggtgctgagtgccggctcccacgaggaggacaagctgcactgcgaggacatcggagaggacacggtcctggtgcggagcggccagggcacggcggcactgccccggagcaccagcctggaccgggactgggccatcaccttcgagcagttcctggcctccctcttaactgagcctgccctggtcaagtactttgacaagcccgtgtgcatgatggccaggattaccagtgcaaaaaacatccggatgatgggcaagcccctcacctcggccagtgactatgaaatctcggccatgtccggctga

SEQ ID NO: 6825 - DNA, 425 bp, Artificial Sequence
  Synthetic polypeptide
aggtctttcaagctggaaacgtgtgggctcaaatgagactccattgcttgctatggactgttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggtataaagcccttggaaaagcacaagacataa

SEQ ID NO: 6826 - DNA, 1013 bp, Artificial Sequence
  Synthetic polypeptide
aggtctttcaagctggaaacgtgtgggctcaaatgagactccattgcttgctatggactgttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaa

SEQ ID NO: 6827 - DNA, 413 bp, Artificial Sequence
  Synthetic polypeptide
aggtctttcaagctggaaacgtgtgggctcaaatgagactccattgcttgctatggactgttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggtataaaggtgaagaattga

SEQ ID NO: 6828 - DNA, 854 bp, Artificial Sequence
  Synthetic polypeptide
aggtctttcaagctggaaacgtgtgggctcaaatgagactccattgcttgctatggactgttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagagaaattcttcatgaaatattttctacggctagatcttaattcctataatagtacttggcaacatggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaa

SEQ ID NO: 6829 - DNA, 742 bp, Artificial Sequence; identical to SEQ ID NO: 6357
  Synthetic polypeptide

SEQ ID NO: 6830 - DNA, 590 bp, Artificial Sequence; identical to SEQ ID NO: 6358
  Synthetic polypeptide

SEQ ID NO: 6831 - DNA, 577 bp, Artificial Sequence; identical to SEQ ID NO: 6359
  Synthetic polypeptide

SEQ ID NO: 6832 - DNA, 430 bp, Artificial Sequence; identical to SEQ ID NO: 6360
  Synthetic polypeptide

SEQ ID NO: 6833 - DNA, 670 bp, Artificial Sequence; identical to SEQ ID NO: 6361
  Synthetic polypeptide

SEQ ID NO: 6834 - DNA, 2262 bp, Artificial Sequence
  Synthetic polypeptide
ggccaggtgtggtggctcacgcctgtaatcccagcactttggtaggccaaggtgggtggatcacgaggtcaggagatccagaccatcctggctaacatggtgaaacctcacctctactagaaatacaaaaaatcagccgggcgtggtggtgggtgcctgtagtcccagctactccggaggctgaggcaagagaatggcgtgaacccgcgaggcggagcttgtgggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatga

SEQ ID NO: 6835 - DNA, 2619 bp, Artificial Sequence
  Synthetic polypeptide
ggccaggtgtggtggctcacgcctgtaatcccagcactttggtaggccaaggtgggtggatcacgaggtcaggagatccagaccatcctggctaacatggtgaaacctcacctctactagaaatacaaaaaatcagccgggcgtggtggtgggtgcctgtagtcccagctactccggaggctgaggcaagagaatggcgtgaacccgcgaggcggagcttgtgggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatga

SEQ ID NO: 6836 - DNA, 305 bp, Artificial Sequence
  Synthetic polypeptide
actagttacaagatgaactggcattacatgcctcctgatacgatgcaatgagaagaacacaacagcatgtctttgatattcctgtggaaaatacataccctcaatcttaccatgagcaaacatcagacaaactcaaatcaagggacattctacaaaataattgacctacattcttcaacagtgtcagcggaggctcacgaggcatggtgactgaagccccgcaggaggtgggatttgcaaaggacattattggaatgaagggtgaaatttgaataagggaccagctctgtgaacacggcaagtaa

SEQ ID NO: 6837 - DNA, 2262 bp, Artificial Sequence; identical to SEQ ID NO: 6834
  Synthetic polypeptide

SEQ ID NO: 6838 - DNA, 2262 bp, Artificial Sequence; identical to SEQ ID NO: 6834
  Synthetic polypeptide

SEQ ID NO: 6839 - DNA, 250 bp, Artificial Sequence
  Synthetic polypeptide
taagtaaggacaacaagaactttaaacaaattttgaactctagctggtaggtttataatttgaagaggccggggtgagcaattctagtctgtacgtattctaggattgatcaaataaatatatcacggataatgggagctggattcctcactgcctgagaaaagaacacaaatagagaaagggagaaagaataaaccctgtaatgctgaaacggaattaaagggaccagctctgtgaacacggcaagtaa

SEQ ID NO: 6840 - DNA, 294 bp, Artificial Sequence; identical to SEQ ID NO: 6413
  Synthetic polypeptide

SEQ ID NO: 6841 - DNA, 462 bp, Artificial Sequence; identical to SEQ ID NO: 6414
  Synthetic polypeptide

SEQ ID NO: 6842 - DNA, 522 bp, Artificial Sequence; identical to SEQ ID NO: 6415
  Synthetic polypeptide

SEQ ID NO: 6843 - DNA, 414 bp, Artificial Sequence; identical to SEQ ID NO: 6416
  Synthetic polypeptide

SEQ ID NO: 6844 - DNA, 405 bp, Artificial Sequence; identical to SEQ ID NO: 6417
  Synthetic polypeptide

SEQ ID NO: 6845 - DNA, 583 bp, Artificial Sequence
  Synthetic polypeptide
tgtggtaggcagaatagcggcccccttaaagatgttcatgtcctaatccccaaaccctgtgaatatgttgccttacatggcaaaagggagattgcagatgtgattactgattttgagatggggagatttcctggattatgcaggttggaccaatggaatcacaagtgtcctaataaatgaaggaggaaggcaggagagtcagagtcagaatgatgcaatgtgtaaacggctcaactggccattcctctctttgaagatggggtcaggccacaagccaaggaacggaggcagcctcttgaacctgaaaaaggcaagaaaatggattctcccctagtgccttcagaaggaacgtggacaagcagaactgttcaaaagaagaggctgttctaagaaagactaccgagtaatcaatcacctcctcagagaaagtctgctcaggaaactctcctcccaccagcccctgcacttggttccttgcgttgcctctggctggaagctgttgtccccaacttcagaaagtgtctgcagatttcacaggctctctcttgggtcaagggaccagctctgtgaacacggcaagtaa

SEQ ID NO: 6846 - DNA, 466 bp, Artificial Sequence
  Synthetic polypeptide
tgtggtaggcagaatagcggcccccttaaagatgttcatgtcctaatccccaaaccctgtgaatatgttgccttacatggcaaaagggagattgcagatgtgattactgattttgagatggggagatttcctggattatgcaggttggaccaatggaatcacaagtgtcctaataaatgaaggaggaaggcaggagagtcagagtcagaatgatgcaatgtgtaaacggctcaactggccattcctctctttgaagatggggtcaggccacaagccaaggaacggaggcagcctcttgaacctgaaaaaggcaagaaaatggattctcccctagtgccttcagaaggaacgtggacaagcagaactgttcaaaagaagaggctgttctaagaaagactaccgagtaatcaatcacctcctcagagaaagtctgctcagggaccagctctgtgaacacggcaagtaa

SEQ ID NO: 6847 - DNA, 413 bp, Artificial Sequence
  Synthetic polypeptide
aaaagtatacgttttcaataggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctattgatagaaaacatgaagaaagcattaagacttattcagtcagagctataa

SEQ ID NO: 6848 - DNA, 404 bp, Artificial Sequence
  Synthetic polypeptide
aaaagtatacgttttcaataggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctatgtaagtattcacaaatgatctcaaacagtggtcatagctga

SEQ ID NO: 6849 - DNA, 363 bp, Artificial Sequence
  Synthetic polypeptide
aaaagtatacgttttcaataggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctat

SEQ ID NO: 6850 - DNA, 326 bp, Artificial Sequence
  Synthetic polypeptide
ctgctcaggaggctgaggcaggaagatcacttgagcccaggagtttgaggctgcggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctga

SEQ ID NO: 6851 - DNA, 119 bp, Artificial Sequence
  Synthetic polypeptide
ctgctcaggaggctgaggcaggaagatcacttgagcccaggagtttgaggctgcggcaccgtataaacttgagttcagacttcctgattactcctgatttctactgggacagagaaaac

SEQ ID NO: 6852 - DNA, 1861 bp, Artificial Sequence; identical to SEQ ID NO: 6680
  Synthetic polypeptide

SEQ ID NO: 6853 - DNA, 1123 bp, Artificial Sequence; identical to SEQ ID NO: 6681
  Synthetic polypeptide

SEQ ID NO: 6854 - DNA, 1850 bp, Artificial Sequence
  Synthetic polypeptide
gagaacaggaactatgttatttatctttgctctctctgctgtgcctgtcctggggcatgtgttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactga

SEQ ID NO: 6855 - DNA, 889 bp, Artificial Sequence
  Synthetic polypeptide
gagaacaggaactatgttatttatctttgctctctctgctgtgcctgtcctggggcatgtgttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaagagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccgggg

SEQ ID NO: 6856 - DNA, 850 bp, Artificial Sequence
  Synthetic polypeptide
gagaacaggaactatgttatttatctttgctctctctgctgtgcctgtcctggggcatgtgttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccag

SEQ ID NO: 6857 - DNA, 192 bp, Artificial Sequence
  Synthetic polypeptide
gagaacaggaactatgttatttatctttgctctctctgctgtgcctgtcctggggcatgtgttacaagttgtttccaaattgcgtcccctcctttgggttccgccatctgctgcctctcacagacagagtggacagcttcaatgaggaagttcggaaacagagggtgtcccggaaccgagatgcccctgagg

SEQ ID NO: 6858 - DNA, 593 bp, Artificial Sequence
  Synthetic polypeptide
aatccaaccacttcctattgcctccatgctactgccctggtccaagcccagatcagatcttgtctagactaccataacagtcacctaactggccaccctacagccagtccacacagaagccagagtgaggctggtagacataaatcagattccatcactcacgtgctcaagtggcttcttatcacagaactaaatccaaatttctgatcacaacctatgaggctgacatgatcaggccaatggctatctctcccttcctaccactctcctcttgctttcttcactctctccagcctggccttcgtgctgttcctcccacagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaa

SEQ ID NO: 6859 - DNA, 635 bp, Artificial Sequence
  Synthetic polypeptide
aatccaaccacttcctattgcctccatgctactgccctggtccaagcccagatcagatcttgtctagactaccataacagtcacctaactggccaccctacagccagtccacacagaagccagagtgaggctggtagacataaatcagattccatcactcacgtgctcaagtggcttcttatcacagaactaaatccaaatttctgatcacaacctatgaggctgacatgatcaggccaatggctatctctcccttcctaccactctcctcttgctttcttcactctctccagcctggccttcgtgctgttcctcccacagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgagtgcttga

SEQ ID NO: 6860 - DNA, 632 bp, Artificial Sequence
  Synthetic polypeptide
aatccaaccacttcctattgcctccatgctactgccctggtccaagcccagatcagatcttgtctagactaccataacagtcacctaactggccaccctacagccagtccacacagaagccagagtgaggctggtagacataaatcagattccatcactcacgtgctcaagtggcttcttatcacagaactaaatccaaatttctgatcacaacctatgaggctgacatgatcaggccaatggctatctctcccttcctaccactctcctcttgctttcttcactctctccagcctggccttcgtgctgttcctcccacagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgaggtga

SEQ ID NO: 6861 - DNA, 459 bp, Artificial Sequence
  Synthetic polypeptide
aatccaaccacttcctattgcctccatgctactgccctggtccaagcccagatcagatcttgtctagactaccataacagtcacctaactggccaccctacagccagtccacacagaagccagagtgaggctggtagacataaatcagattccatcactcacgtgctcaagtggcttcttatcacagaactaaatccaaatttctgatcacaacctatgaggctgacatgatcaggccaatggctatctctcccttcctaccactctcctcttgctttcttcactctctccagcctggccttcgtgctgttcctcccacagctttaaagaaagtgtttgctgaaaataaagaaatccagaaattggcagagcagtttgtcctcctcaatctggtttatgaaacaactgacaaacacctttctcctgatggccagtatgtccccaggattatgtttgttg

SEQ ID NO: 6862 - DNA, 68 bp, Artificial Sequence
  Synthetic polypeptide
ggccaggcacggtggctcacgcctgtaatcccagcacttcgggaggccaaggcctgggcaatatttaa

SEQ ID NO: 6863 - DNA, 1053 bp, Artificial Sequence
  Synthetic polypeptide
ggccaggcacggtggctcacgcctgtaatcccagcacttcgggaggccaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtag

SEQ ID NO: 6864 - DNA, 407 bp, Artificial Sequence
  Synthetic polypeptide
ggccaggcacggtggctcacgcctgtaatcccagcacttcgggaggccaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatttacagacacaactgaggccccctttcaaggggatcagagg

SEQ ID NO: 6865 - DNA, 673 bp, Artificial Sequence
  Synthetic polypeptide
ggccaggcacggtggctcacgcctgtaatcccagcacttcgggaggccaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagcaccaggtagggctgttctatccccagactactcactgctgctcaccttcatctacaacgggcgcgtggtgggcgaggcccaggtgcaaagcctggattgccgccttgtggctgagccctcaggctctgagagcagcatggagcaggtgctgt

SEQ ID NO: 6866 - DNA, 871 bp, Artificial Sequence; identical to SEQ ID NO: 437
  Synthetic polypeptide

SEQ ID NO: 6867 - DNA, 421 bp, Artificial Sequence; identical to SEQ ID NO: 441
  Synthetic polypeptide

SEQ ID NO: 6868 - DNA, 638 bp, Artificial Sequence; identical to SEQ ID NO: 442
  Synthetic polypeptide

SEQ ID NO: 6869 - DNA, 337 bp, Artificial Sequence; identical to SEQ ID NO: 443
  Synthetic polypeptide

SEQ ID NO: 6870 - DNA, 254 bp, Artificial Sequence
  Synthetic polypeptide
gctaggtgtggtggcgcacgcctgtagttccagctacttgggaggctgaagtgggaggatcacttgagcccaggagttcaagatcagcctggacaacatagtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaat

SEQ ID NO: 6871 - DNA, 415 bp, Artificial Sequence
  Synthetic polypeptide
gctaggtgtggtggcgcacgcctgtagttccagctacttgggaggctgaagtgggaggatcacttgagcccaggagttcaagatcagcctggacaacatagtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgcc

SEQ ID NO: 6872 - DNA, 580 bp, Artificial Sequence
  Synthetic polypeptide
gctaggtgtggtggcgcacgcctgtagttccagctacttgggaggctgaagtgggaggatcacttgagcccaggagttcaagatcagcctggacaacatagtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctattgccctcaaattggctgtagccacacggatataagaaagtcagatcttatccaggatgaagcacttagaagggcaattgagaaccataacaagaaaagacatcgtcattccgagtag

SEQ ID NO: 6873 - DNA, 171 bp, Artificial Sequence
  Synthetic polypeptide
ggccaggtgcggtggctctcatctgtaatcccagcactctgggaggccgaggcctccccaaagccagtcctgtgtcaccaatcaaaggaaaggaagccgtcagcagagatgaacagaataaccaccaaggaagccacttcctcctgccccccaaaatcccctcttggagag

SEQ ID NO: 6874 - DNA, 633 bp, Artificial Sequence
  Synthetic polypeptide
ggccaggtgcggtggctctcatctgtaatcccagcactctgggaggccgaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctag

SEQ ID NO: 6875 - DNA, 636 bp, Artificial Sequence
  Synthetic polypeptide
ggccaggtgcggtggctctcatctgtaatcccagcactctgggaggccgaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctag

SEQ ID NO: 6876 - DNA, 480 bp, Artificial Sequence
  Synthetic polypeptide
ggccaggtgcggtggctctcatctgtaatcccagcactctgggaggccgaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattga

SEQ ID NO: 6877 - DNA, 163 bp, Artificial Sequence; identical to SEQ ID NO: 480
  Synthetic polypeptide

SEQ ID NO: 6878 - DNA, 104 bp, Artificial Sequence; identical to SEQ ID NO: 481
  Synthetic polypeptide

SEQ ID NO: 6879 - DNA, 310 bp, Artificial Sequence
  Synthetic polypeptide
ggtcgggtgcggtggctcaagcctgtaatcccagcactttgggaggccgaggtgggcggatcacaaggttgcagagcctgaggcctgtgatcagatgtacgagagcttagcgcgactccattcaaactactacaaacacaagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctga

SEQ ID NO: 6880 - DNA, 733 bp, Artificial Sequence
  Synthetic polypeptide
ggccaggtgcagtggctcacgcctgtaatcccagcactttgggaggccaaggtgggcggatcacttgagaccaggagtttgagacaagcctggccaagatgccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtga

SEQ ID NO: 6881 - DNA, 273 bp, Artificial Sequence
  Synthetic polypeptide
ggccaggtgcagtggctcacgcctgtaatcccagcactttgggaggccaaggtgggcggatcacttgagaccaggagtttgagacaagcctggccaagatgccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatct

SEQ ID NO: 6882 - DNA, 408 bp, Artificial Sequence
  Synthetic polypeptide
attgtaatagagtaagtaaatatttggtctttgtcccagttcttggcacagagctctccaaaaacactcggagtttgcagagtgctaggagtgtctttgtcgttcctagtgatccactttggaccacacctgagtttgttctactgtgaggtgattttggtggggcccctagatagcctcatagttggtttagtcagaaaggccaatcacttgatttgagggttaaaacttgtcggcccacttgccaaccttggggttgcagggccagagattgaactctataaaaactcctaatttgatgtgcttctggattggtgaacaactcgacatactgggcagagaacatttataatgatgaagaccctgaaggaagcgtggatccagaaggacaagggagttagtccttga

SEQ ID NO: 6883 - DNA, 401 bp, Artificial Sequence
  Synthetic polypeptide
attgtaatagagtaagtaaatatttggtctttgtcccagttcttggcacagagctctccaaaaacactcggagtttgcagagtgctaggagtgtctttgtcgttcctagtgatccactttggaccacacctgagtttgttctactgtgaggtgattttggtggggcccctagatagcctcatagttggtttagtcagaaaggccaatcacttgatttgagggttaaaacttgtcggcccacttgccaaccttggggttgcagggccagagattgaactctataaaaactcctaatttgatgtgcttctggattggtgaacaactcgacatactgggcagagaacatttataatgatgaagaccctgaaggaagcgtggatccagaaggacaagggtcctag

SEQ ID NO: 6884 - DNA, 510 bp, Artificial Sequence
  Synthetic polypeptide
attgtaatagagtaagtaaatatttggtctttgtcccagttcttggcacagagctctccaaaaacactcggagtttgcagagtgctaggagtgtctttgtcgttcctagtgatccactttggaccacacctgagtttgttctactgtgaggtgattttggtggggcccctagatagcctcatagttggtttagtcagaaaggccaatcacttgatttgagggttaaaacttgtcggcccacttgccaaccttggggttgcagggccagagattgaactctataaaaactcctaatttgatgtgcttctggattggtgaacaactcgacatactgggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataa

SEQ ID NO: 6885 - DNA, 1883 bp, Artificial Sequence; identical to SEQ ID NO: 6345
  Synthetic polypeptide

SEQ ID NO: 6886 - DNA, 39 bp, Artificial Sequence
  Synthetic polypeptide
ggccaggaagcagaagtgcaagcaaagcagcaagcatga

SEQ ID NO: 6887 - DNA, 2477 bp, Artificial Sequence
  Synthetic polypeptide
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaa

SEQ ID NO: 6888 - DNA, 2399 bp, Artificial Sequence
  Synthetic polypeptide
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaa

SEQ ID NO: 6889 - DNA, 2672 bp, Artificial Sequence
  Synthetic polypeptide
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgttacctggaagactggccaggtggaacgaggcagggcctggaagccaccagcctctctcgccctctgtagcaggagctgcgactctatggtttcatgttacgcttccattctgtgcaaggctctgtggaaggagaagctgcacacattctggcatcataacagaatttcatttcttccatctgcattcaggccaataccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaa

SEQ ID NO: 6890 - DNA, 2267 bp, Artificial Sequence
  Synthetic polypeptide
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaaggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaa

SEQ ID NO: 6891 - DNA, 2114 bp, Artificial Sequence
  Synthetic polypeptide
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtga

SEQ ID NO: 6892 - DNA, 359 bp, Artificial Sequence
  Synthetic polypeptide
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcaggccatgaaggacctgtttatgcggtgcatgctgtttaccagaggaggacatcagatcctgcattatgtacactga

SEQ ID NO: 6893 - DNA, 2462 bp, Artificial Sequence
  Synthetic polypeptide
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagttacctggaagactggccaggtggaacgaggcagggcctggaagccaccagcctctctcgccctctgtagcaggagctgcgactctatggtttcatgttacgcttccattctgtgcaaggctctgtggaaggagaagctgcacacattctggcatcataacagaatttcatttcttccatctgcattcaggccaataccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacagagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaa

SEQ ID NO: 6894 - DNA, 2267 bp, Artificial Sequence
  Synthetic polypeptide
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacagagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaa

SEQ ID NO: 6895 - DNA, 302 bp, Artificial Sequence
  Synthetic polypeptide
tgtcagggaagcaggagcccgggagagccagggtgacacccttttaaaatcaactccgtcgtaaaattagcaaggcacactctttgccagtcaacccacggtcctgagatgtttacggcagaggaagcatcttgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagatatgggcacggttatga

SEQ ID NO: 6896 - DNA, 427 bp, Artificial Sequence; identical to SEQ ID NO: 573
  Synthetic polypeptide

SEQ ID NO: 6897 - DNA, 696 bp, Artificial Sequence
  Synthetic polypeptide
ggccgggcacggtggctcctgcctctaatcccagcactttgggaggccaaggcgggcagattacctgaggtcgggagtttgagatcagcctgaccaacatggagaaaccccatctctatcaaaaaacaaaattagccgagtgtggtgacgcatgcctgtaatcccagctgcttgggaggctgaggcagaagaatcgcttgaacccgggaagcggaagttgtgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagcttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagataatcaggccaggctcagtggctcatgcctataa

SEQ ID NO: 6898 - DNA, 801 bp, Artificial Sequence
  Synthetic polypeptide
ggccgggcacggtggctcctgcctctaatcccagcactttgggaggccaaggcgggcagattacctgaggtcgggagtttgagatcagcctgaccaacatggagaaaccccatctctatcaaaaaacaaaattagccgagtgtggtgacgcatgcctgtaatcccagctgcttgggaggctgaggcagaagaatcgcttgaacccgggaagcggaagttgtgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagggtctctattccaatgtggcctgtccaggtacagcattgaccaatttgacatatggaattctgcctccgtttatatggacgctgttgatgccggcaatattgctacttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagataatcaggccaggctcagtggctcatgcctataa

SEQ ID NO: 6899 - DNA, 128 bp, Artificial Sequence
  Synthetic polypeptide
acaacaacaaaaagaaatgtagagtgccaggcccactgcagacctactgaatcagagcctgaattttaagataccccgcagatgagcaggagactaaagatgcagcagaagaatgtaaagaaccctaa

SEQ ID NO: 6900 - DNA, 3055 bp, Artificial Sequence; identical to SEQ ID NO: 709
  Synthetic polypeptide

SEQ ID NO: 6901 - DNA, 3058 bp, Artificial Sequence; identical to SEQ ID NO: 710
  Synthetic polypeptide

SEQ ID NO: 6902 - DNA, 343 bp, Artificial Sequence; identical to SEQ ID NO: 891
  Synthetic polypeptide

SEQ ID NO: 6903 - DNA, 218 bp, Artificial Sequence
  Synthetic polypeptide
cgaagccgggtgggctgcgggaccctcgagaacccagctggcttcggagtgagctggcccggggctggtacccgctgcgctttttcacagccattgtgaccttgtttcgtgtggctgatcaaagaaagaaggcatacgcagatttctacagaaactacgatgtcatgaaagattttgaggagatgaggaaggctggtatctttcagagtgtaaagtaa

SEQ ID NO: 6904 - DNA, 812 bp, Artificial Sequence; identical to SEQ ID NO: 693
  Synthetic polypeptide

SEQ ID NO: 6905 - DNA, 752 bp, Artificial Sequence; identical to SEQ ID NO: 694
  Synthetic polypeptide

SEQ ID NO: 6906 - DNA, 156 bp, Artificial Sequence
  Synthetic polypeptide
gctgggcatggtgacacacacctgtcatcccagctacttgtgagcccaaggcaggaggattgcttgagcccaggaattgaaggccaaccggggtacacaacaaaacatttgaatgatgagactacctccaagcaaattaaatccatgctgcaataa

SEQ ID NO: 6907 - DNA, 177 bp, Artificial Sequence
  Synthetic polypeptide
tagttaaggggttgagctctggagtcaacgtgtggaccccaacccctctgttaaccagctgtggacactcaaggtccaaacaccctagatgatctctttcaagaactggacaagaatggagatggagaagttagttttgaagaattccaagtattagtaaaaaagatatcccagtga

SEQ ID NO: 6908 - DNA, 472 bp, Artificial Sequence
  Synthetic polypeptide
gtggtggctcacgcctgtaataccggcactttgggaggccgaggcaggtggatcacttgagtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttag

SEQ ID NO: 6909 - DNA, 360 bp, Artificial Sequence
  Synthetic polypeptide
tggtcccagccctcatggcctcactgtatgactaacagctccatgcctcggtttcctcacctgtaaagtgaggattgcagtagcgctcaccctttcaagttgttgaggttacctgagtccgggtgtgtgcctctctcgccaggcccaggagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtga

SEQ ID NO: 6910 - DNA, 280 bp, Artificial Sequence
  Synthetic polypeptide
tggtcccagccctcatggcctcactgtatgactaacagctccatgcctcggtttcctcacctgtaaagtgaggattgcagtagcgctcaccctttcaagttgttgaggttacctgagtccgggtgtgtgcctctctcgccaggcccaggagaccatggtgagagcaccagcaagctggccagtgtgacccgcagcgtggacaaggaccctgggatccccagagctctaagcctcagtggctcctccagctcaccccaagcccaggtgatggtgcacatgg

SEQ ID NO: 6911 - DNA, 3127 bp, Artificial Sequence
  Synthetic polypeptide
gaggaggaagaggaagaggcgaaggctggcggaggaggagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtacgctccatggtgagtgactttgctgttttcctcactatcttcacaatggtgattattgattttttgattggagtcccatcaccaaagcttcaagttcccagtgtgttcaagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagtttattccaatgccagtactctacggagttttcctttacatgggagtttcttcactacagggaattcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcatgcctgaaagcaaaaagaagaagttggatgatgccaaaaagaaggccaaggaggaagaggtcatagtccttgcaccaactgtatacctgggggcctcaaattacagaacatag

SEQ ID NO: 6912 - DNA, 3274 bp, Artificial Sequence
  Synthetic polypeptide
gaggaggaagaggaagaggcgaaggctggcggaggaggagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtacgctccatggtgagtgactttgctgttttcctcactatcttcacaatggtgattattgattttttgattggagtcccatcaccaaagcttcaagttcccagtgtgttcaagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagtttattccaatgccagtactctacggagttttcctttacatgggagtttcttcactacagggaattcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcatgcctgaaagcaaaaagaagaagttggatgatgccaaaaagaaggccaaggaggaagaggaggctgagaaaatgttagaaattgggggagacaagtttcccttagagagcaggaagttactaagtagtcctggaaagaacatcagttgcagatgtgacccctctgagattaatatatctgatgaaatgcctaaaactacagtttggaaagctctcagtatgaattctggaaatgcaaaggaaaagagtctcttcaactaa

SEQ ID NO: 6913 - DNA, 1389 bp, Artificial Sequence; identical to SEQ ID NO: 863
  Synthetic polypeptide

SEQ ID NO: 6914 - DNA, 1012 bp, Artificial Sequence
  Synthetic polypeptide
gagaggtgggaagagggagagaaaagtatgagaaagacaaataaacaggctgaggtagacaatgggtgacacagaaaggaagtgagacagagactaagagagatagaaaggagagaggcagggagatggggcagaggccaagaaaaagacagaaggatgagggaggaagatgcagaaagagctgtttgagctcttctctggcttcttgaaatactttcctggggcacacaggcaagtttacaaaaacctgcaggaaatcaatgcttacattggccacagtgtggagaagcaccgtgaaaccctggaccccagcgcccccaaggacctcatcgacacctacctgctccacatggaaaaagagaaatccaacgcacacagtgaattcagccaccagaacctcaacctcaacacgctctcgctcttctttgctggcactgagaccaccagcaccactctccgctacggcttcctgctcatgctcaaataccctcatgttgcagagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctga

SEQ ID NO: 6915 - DNA, 131 bp, Artificial Sequence
  Synthetic polypeptide
gtggcctagtggttaggaacatgggttctgggtagggaagacctgggtttgaatccttgctctgctgctagatggagatcttagatgagcaggagactaaagatgcagcagaagaatgtaaagaaccctaa

SEQ ID NO: 6916 - DNA, 456 bp, Artificial Sequence; identical to SEQ ID NO: 6649
  Synthetic polypeptide

SEQ ID NO: 6917 - DNA, 480 bp, Artificial Sequence; identical to SEQ ID NO: 6650
  Synthetic polypeptide

SEQ ID NO: 6918 - DNA, 186 bp, Artificial Sequence; identical to SEQ ID NO: 6651
  Synthetic polypeptide

SEQ ID NO: 6919 - DNA, 440 bp, Artificial Sequence
  Synthetic polypeptide
tgatatgttttgaatttgtgtccctacccaaatatcatgtcaaattgtcatccctaatgttggaggaggggcctggtgagaggtgattggatcacagggagggacttccccttgcttttctctcaataatgagttctcacaagatctggttcttcagaagtgtgtggcacctcccctactctctctttctccttctccggccatgcaagacatatctgcttctccttcaccttccactatgattgctggagtgcagtggttcaatcacggatcactgcagcctccacctcccagttcaagaaattctcatgtctcagcctcctgagcagctaggattacagacaaaccttggaaatcaagaaagttctggaatgatgaagctgttcatgccaagaccgaaagtgctggcccagtatgagtccattcagttcatgccgtga

SEQ ID NO: 6920 - DNA, 1737 bp, Artificial Sequence; identical to SEQ ID NO: 905
  Synthetic polypeptide

SEQ ID NO: 6921 - DNA, 284 bp, Artificial Sequence; identical to SEQ ID NO: 906
  Synthetic polypeptide

SEQ ID NO: 6922 - DNA, 856 bp, Artificial Sequence; identical to SEQ ID NO: 907
  Synthetic polypeptide

SEQ ID NO: 6923 - DNA, 802 bp, Artificial Sequence; identical to SEQ ID NO: 908
  Synthetic polypeptide

SEQ ID NO: 6924 - DNA, 561 bp, Artificial Sequence; identical to SEQ ID NO: 909
  Synthetic polypeptide

SEQ ID NO: 6925 - DNA, 582 bp, Artificial Sequence; identical to SEQ ID NO: 910
  Synthetic polypeptide

SEQ ID NO: 6926 - DNA, 1261 bp, Artificial Sequence
  Synthetic polypeptide
tcatgatttgatttaaatgtgacatcctttcttagagaagttttctttgtctccttcttccccagtcacttcctcccatccactgtgctttcggcagttcattcgttcattaattcattcaacgaatattgaataacttttgatcaatgtcttcctccctccaagctgaaaacttgatggagggtaacatgatctgtctttgtttaccactgcatcttccgtgaatatacattggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctga

SEQ ID NO: 6927 - DNA, 925 bp, Artificial Sequence
  Synthetic polypeptide
tcatgatttgatttaaatgtgacatcctttcttagagaagttttctttgtctccttcttccccagtcacttcctcccatccactgtgctttcggcagttcattcgttcattaattcattcaacgaatattgaataacttttgatcaatgtcttcctccctccaagctgaaaacttgatggagggtaacatgatctgtctttgtttaccactgcatcttccgtgaatatacattggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggtatctcacatgtagaagcaaagaagagaatcctgaacttgcatcctaaaatatttggaaacaagtggtttcctcgtgtctaa

SEQ ID NO: 6928 - DNA, 1775 bp, Artificial Sequence; identical to SEQ ID NO: 568
  Synthetic polypeptide

SEQ ID NO: 6929 - DNA, 877 bp, Artificial Sequence
  Synthetic polypeptide
ggccaggccccgtggctcatgcttgtaatgcactttgggaggccaaggcaggcagatggcttgagctgaggagttcacgaccagcctgggcaacatagtgagacctcatctctacaaaacataaacaaaaacttagccagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctga

SEQ ID NO: 6930 - DNA, 670 bp, Artificial Sequence
  Synthetic polypeptide
ggccaggccccgtggctcatgcttgtaatgcactttgggaggccaaggcaggcagatggcttgagctgaggagttcacgaccagcctgggcaacatagtgagacctcatctctacaaaacataaacaaaaacttagccagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaac

SEQ ID NO: 6931 - DNA, 1385 bp, Artificial Sequence
  Synthetic polypeptide
tgtgcatccgaatgatttttatccttttaagtcaccttgagagactgactgatttcagcggtgctgccattgctaaaaccatctttgaattatttggaacttctttcagagccagtttacatgcctcaaaatgaaaattagtcttcctgtatttttactcatttttgattaaaaaaaaagtttttatccaatttgatcacacacctcattctactgaaatcactccgagtgacttttggctgtttccaaaaataaattgactccaaaggatgaagatatgtgatcactgacaggaggtttaatgatgtgccataggttctgaagaaaattcctaaagaggaattccaaaagtgctctgagcaatggcagcgcccttggaataagggtgtagcttcccgaggtgactgactggctggaaggaggcagccatcatttggatgtttaaatactgtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttga

SEQ ID NO: 6932 - DNA, 285 bp, Artificial Sequence
  Synthetic polypeptide
ctgggagattaactaaaacaccgagaacttgggagtggaatcaggcagccctttcagggtctcatgccaagactgccctgatacccgtgggcatcctagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctag

SEQ ID NO: 6933 - DNA, 333 bp, Artificial Sequence
  Synthetic polypeptide
ctgggagattaactaaaacaccgagaacttgggagtggaatcaggcagccctttcagggtctcatgccaagactgccctgatacccgtgggcatcctagatgaagactggcccatttgcagagcactccaaccagctgtggaacatcagcgccgtcccttcctggtccaaagtgaaccagggtctcatccgcatgtataaggccgaggccagcccctctgacacttggggcctcggaatctcccatctggggcatgggcagtcagagaagcaccagccaccccagccccgaaaagctgcagtccagctctgtcctgatgagcttggaggctga

SEQ ID NO: 6934 - DNA, 207 bp, Artificial Sequence
  Synthetic polypeptide
ctgggagattaactaaaacaccgagaacttgggagtggaatcaggcagccctttcagggtctcatgccaagactgccctgatacccgtgggcatcctagatgaagactggcccatttgcagagcactccaaccagctgtggaacatcagcgccgtcccttcctggtccaaagtgaaccagggtctcatccgcatgtataaggccgag

SEQ ID NO: 6935 - DNA, 555 bp, Artificial Sequence
  Synthetic polypeptide
ctgggagattaactaaaacaccgagaacttgggagtggaatcaggcagccctttcagggtctcatgccaagactgccctgatacccgtgggcatcctagatgaagactggcccatttgcagagcactccaaccagctgtggaacatcagcgccgtcccttcctggtccaaagtgaaccagggtctcatccgcatgtataaggccgaggtgagtgggggctggccagtgtgcccgtccctgctgccgcacttggtcctgggctggggacaaagcaaaagatgtggaacctggggctcctgcttcctcctaccccactgttttgctctgaatcttaggccagcccctctgacacttggggcctcggaatctcccatctggggcatgggcagtcagagaagcaccagccaccccagccccgaaaagctgcagtccagctctgtcctgatgagcttggaggctgaggcaaggacctgctgcatggggagtgggggcgatgggggcctcccttctcctttatcaagtggccaaaggctcctcaaagctcgggcagtctga

SEQ ID NO: 6936 - DNA, 225 bp, Artificial Sequence
  Synthetic polypeptide
ctgggagattaactaaaacaccgagaacttgggagtggaatcaggcagccctttcagggtctcatgccaagactgccctgatacccgtgggcatcctagatgaagactggcccatttgcagagcactccaaccagctgtggaacatcagcgccgtcccttcctggtccaaagtgaaccagggtctcatccgcatgtataaggccgaggctggcccttgtgactag

SEQ ID NO: 6937 - DNA, 275 bp, Artificial Sequence; identical to SEQ ID NO: 6546
  Synthetic polypeptide

SEQ ID NO: 6938 - DNA, 1516 bp, Artificial Sequence; identical to SEQ ID NO: 534
  Synthetic polypeptide

SEQ ID NO: 6939 - DNA, 591 bp, Artificial Sequence; identical to SEQ ID NO: 539
  Synthetic polypeptide

SEQ ID NO: 6940 - DNA, 482 bp, Artificial Sequence; identical to SEQ ID NO: 540
  Synthetic polypeptide

SEQ ID NO: 6941 - DNA, 444 bp, Artificial Sequence; identical to SEQ ID NO: 541
  Synthetic polypeptide

SEQ ID NO: 6942 - DNA, 334 bp, Artificial Sequence; identical to SEQ ID NO: 533
  Synthetic polypeptide

SEQ ID NO: 6943 - DNA, 38 bp, Artificial Sequence; identical to SEQ ID NO: 543
  Synthetic polypeptide

SEQ ID NO: 6944 - DNA, 245 bp, Artificial Sequence; identical to SEQ ID NO: 542
  Synthetic polypeptide

SEQ ID NO: 6945 - DNA, 1047 bp, Artificial Sequence
  Synthetic polypeptide
ggctggacgtggtggctcatacctgtaatcccagcactttgggaggctgagttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtga

SEQ ID NO: 6946 - DNA, 1044 bp, Artificial Sequence
  Synthetic polypeptide
ggctggacgtggtggctcatacctgtaatcccagcactttgggaggctgagttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtga

SEQ ID NO: 6947 - DNA, 774 bp, Artificial Sequence
  Synthetic polypeptide
ggctggacgtggtggctcatacctgtaatcccagcactttgggaggctgagttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagaggtgggtgctcccagctcctgctcccctcctggtggcgcggcagagcctccagacacctgctcctgtgccccagcagctccagctgcctctgctttcggagtgtccctgggaccaggatag

SEQ ID NO: 6948 - DNA, 1694 bp, Artificial Sequence
  Synthetic polypeptide
ggccgggcacggtggctcacgcctgtaatcgcagcattttgggaggctgaagcaggtggatcacgaggtcaggagatggagaccatcctggccaacatggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagttttcttctaggccgatgaagccttcccctccgtatctggggctgttacttgcagcaactgggaacctgaatgcctacttgcaacagggttgcaaactgtcttccagtgatagatacagtgatgccagtgatgacagcttttcagagccaaggatagctgagttggaaataagctga

SEQ ID NO: 6949 - DNA, 1498 bp, Artificial Sequence
  Synthetic polypeptide
gggcaaacagctccaggccctcagagctgctcaaggcttttcaacccaggggatgataatcaatgttatgtcaatgaatcagccaaacagacagaaagatcacattatgttttctctgtttgaaaaggatgacaactggggagagaccaccacggccatcacaggcacctcggagcacagcatatcccaagaggacattgccaggatcagcaaggacatggaggacagcgtggggctggattgcaaacgctacctgggcctcaccgtcgcctcttttcttggacttctagttttcctcacccctattgccttcatccttttacctccgatcctgtggagggatgagctggagccttgtggcacaatttgtgaggggctctttatctccatggcattcaaactcctcattctgctcatagggacctgggcactttttttccgcaagcggagagctgacatgccacgggtgtttgtgtttcgtgcccttttgttggtcctcatctttctctttgtggtttcctattggcttttttacggggtccgcattttggactctcgggaccggaattaccagggcattgtgcaatatgcagtctcccttgtggatgccctcctcttcatccattacctggccatcgtcctgctggagctcaggcagctgcagcccatgttcacgctgcaggtggtccgctccaccgatggcgagtcccgcttctacagcctgggacacctgagtatccagcgagcagcattggtggtcctagaaaattactacaaagatttcaccatctataacccaaacctcctaacagcctccaaattccgagcagccaagcatatggccgggctgaaagtctacaatgtagatggccccagtaacaatgccactggccagtcccgggccatgattgctgcagctgctcggcgcagggactcaagccacaacgagttgtattatgaagaggccgaacatgaacggcgagtaaagaagcggaaagcaaggctggtggttgcagtggaagaggccttcatccacattcagcgtctccaggctgaggagcagcagaaagccccaggggaggtgatggaccctagggaggccgcccaggccattttcccctccatggccagggctctccagaagtacctgcgcatcacccggcagcagaactaccacagcatggagagcatcctgcagcacctggccttctgcatcaccaacggcatgacccccaaggccttcctagaacggtacctcagtgcgggccccaccctgcaatatgacaaggaccgctggctctctacacagtggaggcttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaa

SEQ ID NO: 6950 - DNA, 806 bp, Artificial Sequence
  Synthetic polypeptide
ccacccaactcactctgtccatccctcaagactcactcaaagggatctataaagggcactgcttccggatcaatcacttcccagaggacaatgactacgaccacgacagctcggagtacctcctccgcatcgtgcgagcctccagcgtcttccccatcctcagcaccatcctgctcctgctgggtggcctgtgcatcggtgctggcaggatctacagccgcaagaacaacatcgtcctcagtgccggcatcctcttcgtggctgcaggcctcagtaacatcatcggtatcatcgtctacatttccagcaacacaggtgacccgagtgacaagcgggacgaagacaaaaagaaccattacaactacggctggtctttttactttggagctctgtctttcattgtggctgagaccgtgggcgtcctggctgtaaacatttacattgagaaaaataaagagttgaggtttaagaccaaacgggaattccttaaggcgtcttcctcttctccttatgccaggatgccgagctacaggtaccggcgacggcgctcgaggtccagctcaaggtccaccgaggcctcgccctccagggacgtgtcgcccatgggcctgaagatcacaggggccatccccatgggggagctgtccatgtacacgctgtccagggagcccctcaaggtgaccaccgcagccagctacagccccgaccaggaggccagcttcctgcaggtgcatgactttttccagcaggacctgaaggaaggtttccacgtcagcatgctgaaccgacggacgacccctgtgtga

SEQ ID NO: 6951 - DNA, 506 bp, Artificial Sequence
  Synthetic polypeptide
cagcagttcttaacattgctgcatggtagaattacctgggaagctttaccaatttcaggcccttccttaggccaggtacttcagaacctcagagctccccagggggctccactccacagccaagggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctag

SEQ ID NO: 6952 - DNA, 484 bp, Artificial Sequence
  Synthetic polypeptide
agcagacaaggatggagatctgaagactcaaattgaaaagctctggacagaagtcaatgccttgaaggaaattcaagccctgcagacagtctgtctccgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctcaatag

SEQ ID NO: 6953 - DNA, 1052 bp, Artificial Sequence; identical to SEQ ID NO: 447
  Synthetic polypeptide

SEQ ID NO: 6954 - DNA, 1118 bp, Artificial Sequence; identical to SEQ ID NO: 448
  Synthetic polypeptide

SEQ ID NO: 6955 - DNA, 383 bp, Artificial Sequence
  Synthetic polypeptide
gtggtggaatgttgtgatgtgccactcagatccttcttcaggaacaaaggaattatcatgtccatggctggcagagctgtccccaaaatagccatgagttatcagccacctcttggaactgccccaccagaagagaggcacctcgccaagctgaagctatgccatcttttatgtctgatgaggcagtttcatctgatttgaagatgatgaagaaaagttctttgcaaggttgcttattgaatattactgggaaaacaggaaaattaggaggaatgttctggagtgatttatctttttcatcaggggcccgcgttcagtccagccaccagatcaacacattctccaaactcattaactttggagaggctacccagagttcctga

SEQ ID NO: 6956 - DNA, 3278 bp, Artificial Sequence
  Synthetic polypeptide
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtatgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctgcctttccacattacggatgtaacttttatgggttcagaaaatggtcttgcacagaagcatcgaacacctcgccgacgatgtcagcagcccaaaatgctgagtag

SEQ ID NO: 6957 - DNA, 3548 bp, Artificial Sequence
  Synthetic polypeptide
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtatgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcagcctggagaggatatgatgctcggaggaaatttaagaaaataagcaacagaaggaatgagtctgctgctcataatcaagcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctggttcagaaaatggtcttgcacagaagcatcgaacacctcgccgacgatgtcagcagcccaaaatgctgagtagccctgaggacaccatgtactataaccagttaaatggaactctagaatatcaagggagcaagaggaagccaagaaaacttggccaaatcaaagtacttgatggggaagatgaatattacaaatctctgtcaccagtggactgtatccctgaggagaacaactcagcccacccttcctttttttcttcatcctcaaaaggagactcttttgctcaacattaa

SEQ ID NO: 6958 - DNA, 3467 bp, Artificial Sequence
  Synthetic polypeptide
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtatgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctggttcagaaaatggtcttgcacagaagcatcgaacacctcgccgacgatgtcagcagcccaaaatgctgagtagccctgaggacaccatgtactataaccagttaaatggaactctagaatatcaagggagcaagaggaagccaagaaaacttggccaaatcaaagtacttgatggggaagatgaatattacaaatctctgtcaccagtggactgtatccctgaggagaacaactcagcccacccttcctttttttcttcatcctcaaaaggagactcttttgctcaacattaa

SEQ ID NO: 6959 - DNA, 2811 bp, Artificial Sequence
  Synthetic polypeptide
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtatgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcag

SEQ ID NO: 6960 - DNA, 605 bp, Artificial Sequence
  Synthetic polypeptide
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtatgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggtactaaatatttag

SEQ ID NO: 6961 - DNA, 316 bp, Artificial Sequence
  Synthetic polypeptide
acttccaacatgacaatgtgagaagctccactgatatgctcccttgtcaaactggtgaaaattatttttggaactacagacatttaatagcttctagaaatggtactaaggacaaaaagcaaatgaagagacatctattcaagaaaatctacaaaaatttgcctctgcctgtgagtttctggatattgtagagctgctgctccagtctggtgctgaccccactctccgagaccaggatggctgcctgccagaggaggtgacaggctgcaaaacagtttctttggtgctgcagcggcacacaactggcaaggcttaa

SEQ ID NO: 6962 - DNA, 459 bp, Artificial Sequence
  Synthetic polypeptide
ccgggcgatgtagctcacccttgtaatcccagcactttgggaggccgaagcagttggatcatttgaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctattgatagaaaacatgaagaaagcattaagacttattcagtcagagctataa

SEQ ID NO: 6963 - DNA, 450 bp, Artificial Sequence
  Synthetic polypeptide
ccgggcgatgtagctcacccttgtaatcccagcactttgggaggccgaagcagttggatcatttgaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctatgtaagtattcacaaatgatctcaaacagtggtcatagctga

SEQ ID NO: 6964 - DNA, 409 bp, Artificial Sequence
  Synthetic polypeptide
ccgggcgatgtagctcacccttgtaatcccagcactttgggaggccgaagcagttggatcatttgaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctat

SEQ ID NO: 6965 - DNA, 763 bp, Artificial Sequence; identical to SEQ ID NO: 606
  Synthetic polypeptide

SEQ ID NO: 6966 - DNA, 952 bp, Artificial Sequence
  Synthetic polypeptide
ccgggcgcggcggctcacgcctgtaattccagcactttgggaggccgagacgggcggatcacgagatctccattacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttga

SEQ ID NO: 6967 - DNA, 754 bp, Artificial Sequence
  Synthetic polypeptide
ccgggcgcggcggctcacgcctgtaattccagcactttgggaggccgagacgggcggatcacgagatctccattacaagctcataatgaatcagacatcacagaagaaagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttga

SEQ ID NO: 6968 - DNA, 450 bp, Artificial Sequence
  Synthetic polypeptide
ccgggcgcggcggctcacgcctgtaattccagcactttgggaggccgagacgggcggatcacgagatctccattacaagctcataatgaatcagacatcacagaagaaagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccaggtga

SEQ ID NO: 6969 - DNA, 1192 bp, Artificial Sequence
  Synthetic polypeptide
actctctctgagcatggccagtttctatgtcatgaggcagtctagaggaggggaaaaccagctaccatgttgtgagggaactcagacaccttctggagaggcttgtatgctgaagaactaaggcctgcctgcagcaatgtgagtgcgcttgcaagcagatcttctgaagccagcccacagccacatcagtgagcttgggagcacattctcctgcccaatcaagctttccgatgtctgcagccctggctgacagcttgactccaacatcatgaaagaccctgagccagaggcatccagccaagccactccaaaattcctggcctgcagaaactatgtcatccatactgtagggccaatagccaggggccatattaatggttcccacaaggaagaccttgcaaattgctataaatcatctctgaagctcgtgaaagaaaataacatccgatcagttgcatttccctgcatctcaacaggcatttatggctttcccaacgagcctgctgcagtcattgccctcaacaccattaaggaatggcttgccaagaatcaccatgaggtggatcggatcattttctgtgtcttcttagaagttgacttcaaaatctacaaaaagaaaatgaatgagtttttctccgtagacgataataatgaagaagaagaggatgttgaaatgaaagaagattcagatgagaacggtccagaggagaagcaaagtgtggaagaaatggaagagcagagccaagatgcagatggtgtcaacactgtcactgtgcccggccctgcttcagaagaggcagttgaagactgtaaagatgaagattttgcaaaggatgaaaatattacaaaaggcggtgaagtgacagatcattctgtgcgtgaccaagatcatcccgatggacaagagaatgattcaacgaagaatgaaataaaaattgaaacagaatcgcagagctcatatatggaaacagaagaactttcatcaaaccaagaagatgccgtgattgtggagcaaccagaagtgattccattaacagaggaccaagaagaaaaagaaggtgaaaaagctccaggcgaggacacacctaggatgcctgggaaaagtgaaggctccagtgacctagaaaatactccaggtcctgatgcaggggcacaagatgaagcgaaggaacaaagaaatggaactaaatga

SEQ ID NO: 6970 - DNA, 1261 bp, Artificial Sequence
  Synthetic polypeptide
actctctctgagcatggccagtttctatgtcatgaggcagtctagaggaggggaaaaccagctaccatgttgtgagggaactcagacaccttctggagaggcttgtatgctgaagaactaaggcctgcctgcagcaatgtgagtgcgcttgcaagcagatcttctgaagccagcccacagccacatcagtgagcttgggagcacattctcctgcccaatcaagctttccgatgtctgcagccctggctgacagcttgactccaacatcatgaaagaccctgagccagaggcatccagccaagccactccaaaattcctggcctgcagaaactatgtcatccatactgtagggccaatagccaggggccatattaatggttcccacaaggaagaccttgcaaattgctataaatcatctctgaagctcgtgaaagaaaataacatccgatcagttgcatttccctgcatctcaacaggcatttatggctttcccaacgagcctgctgcagtcattgccctcaacaccattaaggaatggcttgccaagaatcaccatgaggtggatcggatcattttctgtgtcttcttagaagttgacttcaaaatctacaaaaagaaaatgaatgagtttttctccgtagacgataataatgaagaagaagaggatgttgaaatgaaagaagattcagatgagaacggtccagaggagaagcaaagtgtggaagaaatggaagagcagagccaagatgcagatggtgtcaacactgtcactgtgcccggccctgcttcagaagaggcagttgaagactgtaaagatgaagattttgcaaaggatgaaaatattacaaaaggcggtgaagtgacagatcattctgtgcgtgaccaagatcatcccgatggacaagagaatgattcaacgaagaatgaaataaaaattgaaacagaatcgcagagctcatatatggaaacagaagaactttcatcaaaccaagaagatgccgtgattgtggagcaaccagaagtgattccattaacagaggaccaagaagaaaaagaaggtgaaaaagctccaggcgaggacacacctaggatgcctgggaaaagtgaaggctccagtgacctagaaaatactccaggtcctgatgttgaaatgaatagtcaggttgacaaggtaaatgacccaacagagagtcaacaagaagatcaactaatagcaggggcacaagatgaagcgaaggaacaaagaaatggaactaaatga

SEQ ID NO: 6971 - DNA, 191 bp, Artificial Sequence
  Synthetic polypeptide
atgtaaagtgcccgcagtgcctggcacatggtgcctttgagatagagataaatggacagctggtgttctccaagctggagaatgggggctttccctatgagaaagatctcattgaggccatccgaagagccagtaatggagaaaccctagaaaagatcaccaacagccgtcctccctgcgtcatcctgtga

SEQ ID NO: 6972 - DNA, 194 bp, Artificial Sequence
  Synthetic polypeptide
atgtaaagtgcccgcagtgcctggcacatggtgcctttgagatagagataaatggacagctggtgttctccaagctggagaatgggggctttccctatgagaaagatgtgagtatttacagcgttgggaggacctcttggtcaccctaccccaacagtgcatcatcctgtcattccactcctctagctcattga

SEQ ID NO: 6973 - DNA, 1009 bp, Artificial Sequence
  Synthetic polypeptide
gggacctttaagaggtgactaggccatgaaaactccaccctcataggtggaatttgtgctgttattgaaaggcaacttcagttccttcttgttctctcttgccctttggccttctgccatgggatgacacagcaagaaggccctcaccagatgccagctgtttggtcttctactttccagccttcagaactacagccttttgattgattatcaatttaccttcagcttattacaggaagatgatcgccaccatactgccataaactttatagcaaacccagaacagtcgaacaaaaatctggatatatcaattaatgcatcaaacaactttaatctcaacattacgtggtctgtcggttcaacagctggaacaatatctggggaagagacttctatagtttccaagaataatataaaggaatacagagatagtttttcctatgaaaaatttaactttagaagcaatcctaacattacattctatgtgtacgtcagcaacttttcctggcctattaaaatacagattgcattctcacaacacaatacaatcatggaccttgtgcagttttttgtcaccttcttcagttgtttcctatccttattgctggtggctgctgtggtatggaagatcaaacaaacttgttgggcttctcgacggagagagcaactgcttcgagaacgacagcagatggccagccgtccctttgcttctgttgatgtagctctggaagtgggagctgaacaaacagagtttctgcgagggccattagagggggcacccaagccaattgccattgaaccatgtgctgggaacagagctgctgttctgactgtgtttctttgtctaccacgaggatcatcaggtgcccctccccctgggcagtcaggccttgcaattgccagtgccctaatagatatttcacaacagaaagcttcagatagtaaagataagacttctggagtccggaatcgaaaacacctttcaacacgtcaaggaacttgtgtctga

SEQ ID NO: 6974 - DNA, 267 bp, Artificial Sequence
  Synthetic polypeptide
gggacctttaagaggtgactaggccatgaaaactccaccctcataggtggaatttgtgctgttattgaaaggcaacttcagttccttcttgttctctcttgccctttggccttctgccatgggatgacacagcaagaaggccctcaccagatgccagctgtttggtcttctactttccagccttcagaactacagccttttgattgattatcaatttaccttcagcttattacaggaagatgatcgccaccatactgccataaactt

SEQ ID NO: 6975 - DNA, 864 bp, Artificial Sequence
  Synthetic polypeptide
agtgaaaagaattgtgcagttggagttagacctatggtttgagactcagctttgggactgagcaaatcatttcacgtgatcaattttctaagctccagtttcctcattaggaaaaaagaagacaaagtaatacttgttgtaatggaattaaatgagataatgtcttcagaatgccattcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattga

SEQ ID NO: 6976 - DNA, 471 bp, Artificial Sequence
  Synthetic polypeptide
agtgaaaagaattgtgcagttggagttagacctatggtttgagactcagctttgggactgagcaaatcatttcacgtgatcaattttctaagctccagtttcctcattaggaaaaaagaagacaaagtaatacttgttgtaatggaattaaatgagataatgtcttcagaatgccattcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccgtattaagggacatcagcgagagaggcagggatcttga

SEQ ID NO: 6977 - DNA, 1905 bp, Artificial Sequence
  Synthetic polypeptide
ggccaggtgtggtggctcacgcctgtaatcccagcactttgggaggcaaaggtgggtggatcacgaggtcaggagatccagaccatcctggctaacatggtgaaaccccacctctactagtaatacaaaaaatcagccgggcgtggtggtgggtgcctgtagtcccagctactccggaggctgagacaaaagaatggcgtgaacccgcgaggcggagcttgtgagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatga

SEQ ID NO: 6978 - DNA, 189 bp, Artificial Sequence
  Synthetic polypeptide
caggggtccccaacccccgtccatgccttgttaggaaccaggccccacagcatgcggtttgttttggagcagtacaacgctctgtcctggctcacgtgcaatccggccacccaggaccgtacttcctgccttcccgtccactttgtggtgctcactcagttgtacaatgccatcatgaatatactttaa

SEQ ID NO: 6979 - DNA, 1397 bp, Artificial Sequence; identical to SEQ ID NO: 657
  Synthetic polypeptide

SEQ ID NO: 6980 - DNA, 120 bp, Artificial Sequence
  Synthetic polypeptide
ggccagtttcgtgtggctgatcaaagaaagaaggcatacgcagatttctacagaaactacgatgtcatgaaagattttgaggagatgaggaaggctggtatctttcagagtgtaaagtaa

SEQ ID NO: 6981 - DNA, 4900 bp, Artificial Sequence
  Synthetic polypeptide
tccattccaagatggctaaatagtaacagctctggtctgcagcttctcgtgtgatcgatgcagaagatgggtgatttctgcatttccagctgaggtacctggttcatctcattgggactggttggacagtggatgcagcccatggagggcaagccaaagaagggtggggcatcacctcacctgggaagtgcaaggggtctggggatttccttttcctagccaagggaagccgtgacaggctgtaccaggaaaattgggacactgccacctaaatactgcacttttccaaagatcttagcaaaaggcatatcaggagattatatcccacgcctggatccgtgggtcccatgcccatggagccttgctcactgctagcacagcagtccgagattgaagtgctaggtggcagcctggctgagggaggggcatccaccattgctgaggcttgagtaggtaaacaaagcagcagggaatctcgaactaggtggagcccaccgcagctcaatgaggcctgcctgcctctgtagactccacctctgtaggcatggcatcgctgaacaaaaggtagcagaaacttctgcagacttaaacatccctgtctgacagctctgaagagagcaatggttctcccagcatggtgtttgagctctgagaatgaacagactgcctcctcaagtgggtccctgaccccactgtagcctaactgggagacatctcccactaggggccaacacacacctcatacagctgggtgcccctctgagatgaagctttcagaggaaggatcaggcagcaatatttgctgttctgcaatatttgctgctctgcagcctctgctggtgatacccaggcaaacagtgttgggagtggacctccagcaaactccaacagaccagcagctgagggacctgactgttagaaggaaaactgacagacagaaaagaattgcatcaacatcaacaaaaaggacacccacaccaaaaccccatctgtaggtcaccatcatcaaaggccaaaggtagataaaaccacaaagatggggagaaaccagagcaggaaagctaaaaattctaaaaaccagggcacctcttctcctccaaaggatcacagctcctcactagtaatggaacaaagctggacagagaatgactttgatgagttggcagaagtaggtttcagaaggtcagtaataacaaacttctctgagctaaaggaggatgttcaaacccatcacaaggaagcaaaaagccttgaaaagagattagatgaatggctaactagaataaacagtgtagagcagactttaaatcacccaatggagctgaaaaccatggcacgagaactatgtgatacatgcacaagcttcagtagacaattcgatcaagtggaggaaagggtatcagtgattgaagatcaaattattgaaatgaagtaagaagagaagtttagagaaaaaggagtaaaaagaaatgaacaaagcctccaagaaatatgggactatgtgaaaagatcaaatctacatcagattggtgtactcgaaagtgaccgagagaatggagccaagttggaaaacactcttcaggatattatgtaggagaacttccccaacctagcaaggtaggccaacatccaaattcaggaaatacagagaccaacaaaaagatactccacgacaagagcacccccaagacacataattgtcagattcaccaaggttgaaatgagggaaaaaatgttaagacagccagagagaacggtcgggttaccaataaagggaagcccatcagactaacagctgatctctcggcacaaactctacaagccaggaaagagtgggggtcaatattcaacattcttaaaaaaaagaattttcaacccagaatttcatatccagccaaactaagcttcataagagaaggagaaataaaatactttacagacaagcaaatgctgagagattttgtcaccaccaggactgccttacaagagctcctgaaggaagcactaaagatggaaaggaacaaccagtaccagccactgcaaaaacatgccagattgtaaagaccatcaatgctaggaagaaactgcatcaactaatgagcaaaataaccagctaacatcataatgacaggatcaaattcatgcataacaatattaaccttaaatgtaaatgggctaaatgctccaattaaaagacacagactggcaaattggataaagagtcaagacccatcagtgtgctgtattgaggagacccatctcatgtgcagcaacacacaaaggctcaaaataaagggatggaggaagttctgccaagcaaatggaaagcaaaaaaaaggcaggggttgcaatcctagtctctgaaaaaacagacttcaaaccaacaaagatcaaaagatacaaagaagaccattacaacaatggtaaagggatcaattcaacaagaagagctaactattctaaacatatatgcacccaatacaggagcacccagattcataaagcaagtccttagagacctacaaagagacttagactcccacacaataatgggagactttaacaccccactgtcaatattagatgtatcaatgagacagaaggttaacaaggatatccaggacttaaactcagctctgcaccacgcagacctaatagacatctacagaactctccaccccaaatcaatagaatatacattcttctcaggaccacatcatatttattccaaaattgaccacatagttggaagtgaagcaccccttagcaaatgtaaaagaacagaaattaccacaaattgtctctcagaccacagtgcaatcaaattagagctcaggattaagaaactcactcaaaactgcacaactacatggaaattgaacaacctgttcctgaatgactactgggtacataacgaaatgaaggcagaaataaagatgttctttgaaaccagtgagaacaaagacacaacataccagaatctctgggacacatttaaaggagggtgtagagggaaatttatagcactaaatgcccacaagagaaaccaggaaagatctaaaatcaatctcctaacatcacaattaaaagaactagagaagcaagagcaaacacattcaaaagctagcagaaggcaagaaataactaagatcagagcagaactgaaggagatagagacacaaaaaccccttcaaaaaatcaaggaatccaggagctggttttttgaaaagatcaacaaaattgatagaccactagcaagactaataaagaagaaaagagagaagaatcaaatagacgcaataaaaaatgataaaggggatatcaccgctgatcccacagaaatacaaactaccgtcagagaatactatacacatctctatgcaaataaattacaaaacctagaagacatggataaattcctggagacatacaccctcccacgactaaaccagaaagaagttgaatcactgaatagacccataacaggttctgaaattgaggcaataattactggcctaccaaccaaaaagagtccacaaccagacagattcacagccgaattctaccagaggtacaaagaggagctggtactgttccttctgaaactattccaatcaatacaaaaaagagggaatcctccctaactgattttatgaggccagcatcatcctgataccaaagcctggcagagacacaataaaaaaagagaattttagaccaacatccctgatgaacatcgatgcgaaaatcctcaataatatactggcaaaccgaatccagcagcacatcaaaaagcttatccaccaagatgaagttggcttcattcctggaatgcaaggctggttgaacatatgcaaatcaataaacttaatccatcacataaacagaaccaatgacaaaaaccacatgattatctcaatagatgcagaaaaggccttcaacaaaattcaagaactcttcatgctaaaaactctcaataaattaggtattgatggaacatatctcaaaataataagagctatttatgacaaacccacagccaatatcatactgaatgggcaaaactggaagcattccctttgaaaactggcacaagacaggggtgccctctctcaccacccctattcaacatagtgttggaagttctggccaggaccatcaggcaagagaaaaaaagaaagtgtattcagttaggaaaagatgaagtcaaattgtccctgtttgcagttgacatgattttatatttagaaaacaccatcatctcagcccaaaatttccttaagctgataagtaacttcagcaaagtctcaggatacaaaatcaatgtgcaaaaatcacaagcattcttatacaccaataacagacaaacagagaggcaaatcatgaatgaactcccattcacaattgctacaaagagaataaaatacctaggaatccaacttacaagggatgtgaaggacctcttcaaggagaactacaaaccactgctcaatgaaataaaagaggacacaaacaaatggaagagcattccatgctcatggataggaaaaatcaatatcgtgaaaatggccatactgcccaaggaataactgtgtttatcaatatttgggctcttcaccacaacccctatttctgggaagaccctcaggtctttaaccccttgagattctccagggaaaattctgaaaaaatacatccctatgccttcataccattctcagctggattaaggaactgcattgggcagcattttgccataattgagtgtaaagtggcagtggcattaactctgctccgcttcaagctggctccagaccactcaaggcctccccagcctgttcgtcaagttgtcctcaagtccaagaatggaatccatgtgtttgcaaaaaaagtttgctaa

SEQ ID NO: 6982 - DNA, 1313 bp, Artificial Sequence
  Synthetic polypeptide
tgtgagctcattgagagctgggtccaggactggcggtcggcctggacccccagggctacgggaaccccgacttctgctggctgtcgcttcaagacaccctgatttggagctttgcggggcccatcggagctgttataatcatcaacacagtcacttctgtcctatctgcaaaggtttcctgccaaagaaagcaccattattatgggaaaaaagggatcgtctccctgctgaggaccgcattcctcctgctgctgctcatcagcgccacctggctgctggggctgctggctgtgaaccgcgatgcactgagctttcactacctcttcgccatcttcagcggcttacagggccccttcgtcctccttttccactgcgtgctcaaccaggaggtccggaagcacctgaagggcgtgctcggcgggaggaagctgcacctggaggactccgccaccaccagggccaccctgctgacgcgctccctcaactgcaacaccaccttcggtgacgggcctgacatgctgcgcacagacttgggcgagtccaccgcctcgctggacagcatcgtcagggatgaagggatccagaagctcggcgtgtcctctgggctggtgaggggcagccacggagagccagacgcgtccctcatgcccaggagctgcaaggatccccctggccacgattccgactcagatagcgagctgtccctggatgagcagagcagctcttacgcctcctcacactcgtcagacagcgaggacgatggggtgggagctgaggaaaaatgggacccggccaggggcgccgtccacagcacccccaaaggggacgctgtggccaaccacgttccggccggctggcccgaccagagcctggctgagagtgacagtgaggaccccagcggcaagccccgcctgaaggtggagaccaaggtcagcgtggagctgcaccgcgaggagcagggcagtcaccgtggagagtaccccccggaccaggagagcgggggcgcagccaggcttgctagcagccagcccccagagcagaggaaaggcatcttgaaaaataaagtcacctacccgccgccgctgacgctgacggagcagacgctgaagggccggctccgggagaagctggccgactgtgagcagagccccacatcctcgcgcacgtcttccctgggctctggcggccccgactgcgccatcacagtcaagagccctgggagggagccggggcgtgaccacctcaacggggtggccatgaatgtgcgcactgggagcgcccaggccgatggctccgactctgagaaaccgtga

SEQ ID NO: 6983 - DNA, 827 bp, Artificial Sequence
  Synthetic polypeptide
tagtgggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatct

SEQ ID NO: 6984 - DNA, 2257 bp, Artificial Sequence
  Synthetic polypeptide
tagtgggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatctgccagaaactcaagcagtccagctcgccctctccgcccgaggagcccccggccccaagttcaacctctgtggaaaaaatgtttggaggcaagatagtgactcggatctgctgtctctgctgcctcaacgtctcctcccgggaggaggccttcacggacctctctctcgccttccctcctcctgagcgctgtcgccgccgccgcctgggctctgtgatgcgccccacagaagacatcacagcccgggagttgcccccaccaaccagtgcacaggggccaggcagggtgggtcctcggaggcaaaggaaacactgcatcacagaggacaccccccccaccagcctgtacatcgaaggcctggactccaaggaagctggtgggcagagcagtcaggaggaaaggatagagagggaggaagaagggaaggaggagagaacggagaaggaagaagtgggggaggaggaggaaagcaccagaggggaaggagagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgcgagtcgtgtgcctccctgcaggatgccgagaaggtggtggagctgagccaagggccgtgctacctcatcctcacactgctgcgcttctctttcgacctgcgcaccatgcggcgccgcaagatcctggatgacgtctccatccccctgctgctccgcctgccactggctggtggccgtggccaggcctatgacctctgcagtgtggtggtgcactctggagtgtcttcggagagtggtcactactactgctatgcccgtgagggcgctgcccgccctgccgcttctctgggaactgccgataggccagagcccgagaaccagtggtacctgttcaatgacactcgggtgtccttctcttccttcgaatctgtcagcaacgtcacctccttcttccctaaggacacagcctatgtgctgttttaccggcagcggcccagggaggggcccgaggctgagttgggctcttctagagtccggacagagcccaccctgcacaaggacttgatggaagccatttccaaagacaacatcctttacctacaggagcaggagaaggaggcccggagcagggcggcctacatctctgcactccccacatctccgcactgggggaggggctttgatgaagacaaggatgaggatgaaggctctccagggggctgcaatcctgcaggtggcaatggtggtgacttccacagactggtcttctaa

SEQ ID NO: 6985 - DNA, 3119 bp, Artificial Sequence
  Synthetic polypeptide
gttcatggatcagttttaagagatcaataaatccctcaccctgcaaattaggccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaa

SEQ ID NO: 6986 - DNA, 3110 bp, Artificial Sequence
  Synthetic polypeptide
gttcatggatcagttttaagagatcaataaatccctcaccctgcaaattaggccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggaggttggcatggatcctattagctgtgtaatactggaattatcaatgatatgcactggtggaggtgttatttgtgctttagaagatacttgctgttga

SEQ ID NO: 6987 - DNA, 3053 bp, Artificial Sequence
  Synthetic polypeptide
gttcatggatcagttttaagagatcaataaatccctcaccctgcaaattaggccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatggtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaa

SEQ ID NO: 6988 - DNA, 818 bp, Artificial Sequence
  Synthetic polypeptide
ctcggctcccccttcaagagtaaacacatttttggctgcaagaagtgcagttaaccgacaggctctagctgcagcaccttcgggatctacgctgttcccggcagccccagcccatggctgtgcacagcaagagtcctggcaccaggacagtcttgcacagctagagtcccagtgcctggacatgcctgcccaccacaggccttctctaacgggcagtcggtgccagagctccctgctaagtcagctgagactgtgagacgcatcaaggcagccaaaggagactctggagatggtgtggatccgaggaagtggttgcggtccttcaggagtccatcagcctccccctggaaataccaccagatgaagaggttgagaacatcatctggtcctctcacaaaagtcttgccactgtggtgccagggaaagagggacatccagctaccatcatggtgaccaatccacactaccagggccaagtgagcttcctggaccccagctattccctgcatatcagcaatctgagctgggaggattcagggctttaccaagctcaagtcaacctgagaacatcccagatctctaccatgcagcagtacaatatatgtgtctaccatcctaactatgcttctgagaagccttcaacagccttctgcctcctggccaagggattgctcatcttcttgctcttggtaattctggccatgggactctgggtcatccgagtccagaaaagacacaaaatgccaaggatgaagaaactcatgagaaacagaatgaaattgaggaaggaggcaaagcctggctccagccctgcctga

SEQ ID NO: 6989 - DNA, 1091 bp, Artificial Sequence
  Synthetic polypeptide
ctcggctcccccttcaagagtaaacacatttttggctgcaagaagtgcagttaaccgacaggctctagctgcagcaccttcgggatctacgctgttcccggcagccccagcccatggctgtgcacagcaagagtcctggcaccaggacagtcttgcacagctagagtcccagtgcctggacatgcctgcccaccacaggccttctctaacgggcagtcggtgccagagctccctgctaagtcagctgagactgtgagacgcatcaaggcagccaaaggagactctggagatggtgtggatccgaggaagtggttgcggtccttcaggagtccatcagcctccccctggaaataccaccagatgaagaggttgagaacatcatctggtcctctcacaaaagtcttgccactgtggtgccagggaaagagggacatccagctaccatcatggtgaccaatccacactaccagggccaagtgagcttcctggaccccagctattccctgcatatcagcaatctgagctgggaggattcagggctttaccaagctcaagtcaacctgagaacatcccagatctctaccatgcagcagtacaatatatgtgtctaccgatggctgtcagagccccagatcactgtgaactttgagagttctggggaaggtgcctgcagtatgtccctggtgtgctctgtggagaaggcaggcatggatatgacctacagctggctctcccggggggatagcacttatacattccatgaaggccctgtcctcagcacatcctggaggccgggggacagtgccctctcctacacctgcagagccaacaaccccatcagcaacgtcagttcttgccccatccctgatgggcccttctatgcagatcctaactatgcttctgagaagccttcaacagccttctgcctcctggccaagggattgctcatcttcttgctcttggtaattctggccatgggactctgggtcatccgagtccagaaaagacacaaaatgccaaggatgaagaaactcatgagaaacagaatgaaattgaggaaggaggcaaagcctggctccagccctgcctga

SEQ ID NO: 6990 - DNA, 859 bp, Artificial Sequence
  Synthetic polypeptide
gaggccatgggttcttgcctccagctaacctgttaactggaggatcttgggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctga

SEQ ID NO: 6991 - DNA, 657 bp, Artificial Sequence
  Synthetic polypeptide
gaggccatgggttcttgcctccagctaacctgttaactggaggatcttgggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcc

SEQ ID NO: 6992 - DNA, 587 bp, Artificial Sequence
  Synthetic polypeptide
gaggccatgggttcttgcctccagctaacctgttaactggaggatcttgggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcg

SEQ ID NO: 6993 - DNA, 568 bp, Artificial Sequence
  Synthetic polypeptide
gaggccatgggttcttgcctccagctaacctgttaactggaggatcttgggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagc

SEQ ID NO: 6994 - DNA, 494 bp, Artificial Sequence
  Synthetic polypeptide
gaggccatgggttcttgcctccagctaacctgttaactggaggatcttgggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcaggtgggcctctgtctgggagggtggcgtgggg

SEQ ID NO: 6995 - DNA, 368 bp, Artificial Sequence
  Synthetic polypeptide
gaggccatgggttcttgcctccagctaacctgttaactggaggatcttgggcgaagctgctctcaggggagaacccagaatacagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttg

SEQ ID NO: 6996 - DNA, 661 bp, Artificial Sequence
  Synthetic polypeptide
gcacctgtaatcccaactactccagaggctgagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatag

SEQ ID NO: 6997 - DNA, 658 bp, Artificial Sequence
  Synthetic polypeptide
gcacctgtaatcccaactactccagaggctgagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatca

SEQ ID NO: 6998 - DNA, 654 bp, Artificial Sequence
  Synthetic polypeptide
ggccaggtgcggtggctctcatctgtaatcccagcactctgggaggccgaggtgggtggatcacctgaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctag

SEQ ID NO: 6999 - DNA, 651 bp, Artificial Sequence
  Synthetic polypeptide
ggccaggtgcggtggctctcatctgtaatcccagcactctgggaggccgaggtgggtggatcacctgaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctag

SEQ ID NO: 7000 - DNA, 498 bp, Artificial Sequence
  Synthetic polypeptide
ggccaggtgcggtggctctcatctgtaatcccagcactctgggaggccgaggtgggtggatcacctgaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattga

SEQ ID NO: 7001 - DNA, 189 bp, Artificial Sequence
  Synthetic polypeptide
ggccaggtgcggtggctctcatctgtaatcccagcactctgggaggccgaggtgggtggatcacctgaggcctccccaaagccagtcctgtgtcaccaatcaaaggaaaggaagccgtcagcagagatgaacagaataaccaccaaggaagccacttcctcctgccccccaaaatcccctcttggagag

SEQ ID NO: 7002 - DNA, 2471 bp, Artificial Sequence; identical to SEQ ID NO: 576
  Synthetic polypeptide

SEQ ID NO: 7003 - DNA, 1514 bp, Artificial Sequence
  Synthetic polypeptide
aaattggtaccaggaatgaggtactgcctaaagatacctaaaaatgtggaagcaattttggaactgggtaatgggcagtggctggaacagtttggagggctcagaagaagataggaagatgtgggaaagtttggaacttcctagagacttgttgaatagttttgaccaaaattctgatagtgacatggacaatgaagtctaggctgaggtggtgtcagatggagatgaggaactttttgggaactggagcagaggtcactcttgttatatcttagcaaagagactggtggcattttgctcccaccctagaggtctgtggaattttgaacttgagaaagatgatttagggtatctggcagaagaaatttctaagcagcaaagcattcaagaagtgacctggcttttggtaaaagtgtatgcccatattcgttcacaaagaaaaaatcagaaattggaagttaaagggaagcagaccgtaaaagtttgaaaaatttgcagcctgaccatgcagtaaaaaagaaaaacctatcttctggcaataaattcaagctggctgcagatatttgcataagtaatgaggagcccaatgttaatggcaaagacaatgaggaaagtacctccagggcatgtcagagatcttcacagcagcccctcccatcgcaagcctggcagcctagtagggaaaaatggttttatgggtcaggccagggccctgctcctctgttcagccttgggacattgtaccctgcatcccagccactccagctccagccgtggctaaaaggggccaaggtacagctcaaactatggcttaagaggatgcaatccccaagtcttacagcttccacgtggtgttgggcctgctgctgtgcaaaagacgagagttcagctttgggagcctccatctagatttcagagaatgtatggagatgtctgaatgtccaagcagaaatctgctgcaggtcagagccctcaaggagaacctctgctacagcagtgcagaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtga

SEQ ID NO: 7004 - DNA, 1529 bp, Artificial Sequence
  Synthetic polypeptide
aaattggtaccaggaatgaggtactgcctaaagatacctaaaaatgtggaagcaattttggaactgggtaatgggcagtggctggaacagtttggagggctcagaagaagataggaagatgtgggaaagtttggaacttcctagagacttgttgaatagttttgaccaaaattctgatagtgacatggacaatgaagtctaggctgaggtggtgtcagatggagatgaggaactttttgggaactggagcagaggtcactcttgttatatcttagcaaagagactggtggcattttgctcccaccctagaggtctgtggaattttgaacttgagaaagatgatttagggtatctggcagaagaaatttctaagcagcaaagcattcaagaagtgacctggcttttggtaaaagtgtatgcccatattcgttcacaaagaaaaaatcagaaattggaagttaaagggaagcagaccgtaaaagtttgaaaaatttgcagcctgaccatgcagtaaaaaagaaaaacctatcttctggcaataaattcaagctggctgcagatatttgcataagtaatgaggagcccaatgttaatggcaaagacaatgaggaaagtacctccagggcatgtcagagatcttcacagcagcccctcccatcgcaagcctggcagcctagtagggaaaaatggttttatgggtcaggccagggccctgctcctctgttcagccttgggacattgtaccctgcatcccagccactccagctccagccgtggctaaaaggggccaaggtacagctcaaactatggcttaagaggatgcaatccccaagtcttacagcttccacgtggtgttgggcctgctgctgtgcaaaagacgagagttcagctttgggagcctccatctagatttcagagaatgtatggagatgtctgaatgtccaagcagaaatctgctgcaggtcagagccctcaaggagaacctctgctacagcagtgcagaggatcttaatgatttaagaatggagggagtaacaaccctggtaccttctgggagcaaatttaaccaaggccgtcctacttaccctgctgagcctcaggccaaggtcacactgaacatctgttcaaggtgtgccaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacacctactaaatcagaatctctgtggctgggactctgaattctgcatttttcatactttggcttctttcctcatctataaataa

SEQ ID NO: 7005 - DNA, 265 bp, Artificial Sequence
  Synthetic polypeptide
gcacggagtcaaggcggataagaaggcggcacaagaaaagatgatccagcaggagcatgagcggcaggagcgggaagacgagcttcgagccatggcccgcaagatccgcatgaaggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattag

SEQ ID NO: 7006 - DNA, 21 bp, Artificial Sequence
  Synthetic polypeptide
gcacggagtcaaggcggataa

SEQ ID NO: 7007 - DNA, 343 bp, Artificial Sequence
  Synthetic polypeptide
gcacggagtcaaggcggataagaaggcggcacaagaaaagatgatccagcaggagcatgagcggcaggagcgggaagacgagcttcgagccatggcccgcaagatccgcatgaaggtgttggaagcacctgccctccctgagttcagtgtgtccagtgttcccggccagatgctcatgccatgccttcgcagggagcgggaacgccgagagaaggagagagaagagtgggaacgccagtacagccggcagagccgctcaccctccccccgatacagtcgagaatacagctcttctcgaaggcgctcaaggtcccgatcccgaagcccccattaccgacattag

SEQ ID NO: 7008 - DNA, 753 bp, Artificial Sequence
  Synthetic polypeptide
ttgttctaacaatcaggatgctccaaagtgacctgcatcagcttgacccgggaggcctccattaaactgtcacccttgcatggcaaacagatttccatccgctacctggacatgacggactgcttcgtgctggaggacgaaggcctgcacaccatcgcggcgcactgcacgcagctcacccacctctacctgcgccgctgcgtccgcctgaccgacgaaggcctgcgctacctggtgatctactgcgcctccatcaaggagctgagcgtcagcgactgccgcttcgtcagcgacttcggcctgcgggagatcgccaagctggagtcccgcctgcggtacctgagcatcgcgcactgcggccgggtcaccgacgtgggcatccgctacgtggccaagtactgcagcaagctgcgctacctcaacgcgaggggctgcgagggcatcacggaccacggtgtggagtacctcgccaagaactgcaccaaactcaaatccctggatatcggcaaatgccctttggtatccgacacgggcctggagtgcctggccctgaactgcttcaacctcaagcggctcagcctcaagtcctgcgagagcatcaccggccagggcttgcagatcgtggccgccaactgctttgacctccagacgctgaatgtccaggactgcgaggtctccgtggaggccctgcgctttgtcaaacgccactgcaagcgctgcgtcatcgagcacaccaacccggctttcttctga

SEQ ID NO: 7009 - DNA, 495 bp, Artificial Sequence
  Synthetic polypeptide
gaaaacttatttgagggaataattgaggaaaacttccctggccttgctagagatctagacatccaactacaagaggctcaaagaacagccaggaaatttgtcacaaaaagatcatcacctaggcacatggtcatcaggttacataaaatcaagacaaaggaaagaatcttaagagctgtgaggcaaaagcatcagattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatga

SEQ ID NO: 7010 - DNA, 74 bp, Artificial Sequence
  Synthetic polypeptide
ggccaggcatggtacttcacacctgtaatctcagcactttgggaggccgagatgatggacaagaaatagcctga

SEQ ID NO: 7011 - DNA, 504 bp, Artificial Sequence
  Synthetic polypeptide
cagtgattcccaaatgtggctgacatcagaaatcacctgggaaagacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcg

SEQ ID NO: 7012 - DNA, 2153 bp, Artificial Sequence
  Synthetic polypeptide
cagtgattcccaaatgtggctgacatcagaaatcacctgggaaagacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattggggatgaagctctgcccacggtcctggtcggcgtgttcatcgaacagcccacgccgtttgtgtccctgttcttccagcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaacgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacgccctgcccggatgtctattggttccccatcttcacggaggtggcctgtgatgagctggtggaggagatggagcactttggccagtggtctctgggcaacaacaaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggcccagtttgacctggcctttgtcgtccgctacaagcctgatgagcagccctcactgatgccacaccatgatgcctccaccttcaccatcaacatcgccctgaaccgagtcggggtggattacgagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaa

SEQ ID NO: 7013 - DNA, 818 bp, Artificial Sequence
  Synthetic polypeptide
cagtgattcccaaatgtggctgacatcagaaatcacctgggaaagacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggtgtctccctggggccagggccaccttcctggggcctgctatgaactcactgcctctgtcctcacatctgagctcagcgtgatgccttcttttcctgctgtggtgctgcagttgaactacctgggcaactacatcccgcgcttctggaccttcgaaacaggctgcaccgtgtgtgacgaaggcttgcgcagcctcaagggcattggg

SEQ ID NO: 7014 - DNA, 1192 bp, Artificial Sequence
  Synthetic polypeptide
gaccaggtgcagtggctcacgcctgtaatctcagcactttgggaggccgaggcgggcagatcacttgaggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaa

SEQ ID NO: 7015 - DNA, 454 bp, Artificial Sequence
  Synthetic polypeptide
gaccaggtgcagtggctcacgcctgtaatctcagcactttgggaggccgaggcgggcagatcacttgaggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaacccataggcatgaaatga

SEQ ID NO: 7016 - DNA, 517 bp, Artificial Sequence
  Synthetic polypeptide
cctcacctttccctcttccactttcgctcacctggattttgttccactgaaaccactgttacgaaagtcaccagtgacttccaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataa

SEQ ID NO: 7017 - DNA, 445 bp, Artificial Sequence; identical to SEQ ID NO: 744
  Synthetic polypeptide

SEQ ID NO: 7018 - DNA, 59 bp, Artificial Sequence; identical to SEQ ID NO: 742
  Synthetic polypeptide

SEQ ID NO: 7019 - DNA, 123 bp, Artificial Sequence; identical to SEQ ID NO: 743
  Synthetic polypeptide

SEQ ID NO: 7020 - DNA, 977 bp, Artificial Sequence
  Synthetic polypeptide
gtggaagcagcagctgggtactgggaggcctgagcttctgttccagcagcaccgttcactggaggcacatgacctcgggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaa

SEQ ID NO: 7021 - DNA, 881 bp, Artificial Sequence
  Synthetic polypeptide
gtggaagcagcagctgggtactgggaggcctgagcttctgttccagcagcaccgttcactggaggcacatgacctcgggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtga

SEQ ID NO: 7022 - DNA, 110 bp, Artificial Sequence
  Synthetic polypeptide
gtggaagcagcagctgggtactgggaggcctgagcttctgttccagcagcaccgttcactggaggcacatgacctcgggcccctccagccagcgtcaggtgcagaatggc

SEQ ID NO: 7023 - DNA, 270 bp, Artificial Sequence
  Synthetic polypeptide
gtggaagcagcagctgggtactgggaggcctgagcttctgttccagcagcaccgttcactggaggcacatgacctcgggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggc

SEQ ID NO: 7024 - DNA, 684 bp, Artificial Sequence
  Synthetic polypeptide
gtggaagcagcagctgggtactgggaggcctgagcttctgttccagcagcaccgttcactggaggcacatgacctcgggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcag

SEQ ID NO: 7025 - DNA, 164 bp, Artificial Sequence; identical to SEQ ID NO: 831
  Synthetic polypeptide

SEQ ID NO: 7026 - DNA, 193 bp, Artificial Sequence; identical to SEQ ID NO: 834
  Synthetic polypeptide

SEQ ID NO: 7027 - DNA, 369 bp, Artificial Sequence; identical to SEQ ID NO: 6492
  Synthetic polypeptide

SEQ ID NO: 7028 - DNA, 552 bp, Artificial Sequence
  Synthetic polypeptide
gtcagtgagttggggaaggcagatccaccctaaatctgctgggcacaatctaatcagcttccagcaaatataaagcaggtagaaaaacgtgaaaaagagagacaggcctagcctcccactttacatgtttctcccgtgctggacgcttcctgcctttgaacgtcggacttcaagttcttcagttttgggacttggactggctctccttgatcctcagcttgcagaaagcctattgtggaaccttgtgatcatattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatga

SEQ ID NO: 7029 - DNA, 3052 bp, Artificial Sequence
  Synthetic polypeptide
gactcagattcgaatcctggctttgctacatactacctgtgtgaggctctttaagcctcagtgacctcatctgtgaaatgtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctga

SEQ ID NO: 7030 - DNA, 3055 bp, Artificial Sequence
  Synthetic polypeptide
gactcagattcgaatcctggctttgctacatactacctgtgtgaggctctttaagcctcagtgacctcatctgtgaaatgtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctga

SEQ ID NO: 7031 - DNA, 970 bp, Artificial Sequence; identical to SEQ ID NO: 711
  Synthetic polypeptide

SEQ ID NO: 7032 - DNA, 701 bp, Artificial Sequence; identical to SEQ ID NO: 658
  Synthetic polypeptide

SEQ ID NO: 7033 - DNA, 233 bp, Artificial Sequence; identical to SEQ ID NO: 856
  Synthetic polypeptide

SEQ ID NO: 7034 - DNA, 308 bp, Artificial Sequence
  Synthetic polypeptide
ggttgggcatggtggctcacgcctgtaatcccagcgctttggaaggccgaggtgagaaaaaccagaagcttgaagaccatagtgagaaaaactggaagcttgaagaccatggtgagaaaaaccagaagcttgaagaccatggtgtgaaaatccttgaacccacccaaatacctgctccaggtccagttcctgttccaggtcccaaaagccatccttctgcatcctcgggcaaactgctgcttccacagtttgggatggtcatcattttaatcagtgtttctgctataaatctctttgttgctctgtag

SEQ ID NO: 7035 - DNA, 341 bp, Artificial Sequence
  Synthetic polypeptide
ggttgggcatggtggctcacgcctgtaatcccagcgctttggaaggccgaggtgagaaaaaccagaagcttgaagaccatagtgagaaaaactggaagcttgaagaccatggtgagaaaaaccagaagcttgaagaccatggtgtgaaaatccttgaacccacccaaatacctgaagataaaagtcaaggaaatatcaacaatcctactccaggtccagttcctgttccaggtcccaaaagccatccttctgcatcctcgggcaaactgctgcttccacagtttgggatggtcatcattttaatcagtgtttctgctataaatctctttgttgctctgtag

SEQ ID NO: 7036 - DNA, 374 bp, Artificial Sequence
  Synthetic polypeptide
ggttgggcatggtggctcacgcctgtaatcccagcgctttggaaggccgaggtgagaaaaaccagaagcttgaagaccatagtgagaaaaactggaagcttgaagaccatggtgagaaaaaccagaagcttgaagaccatggtgtgaaaatccttgaacccacccaaatacctggaatgaaaattccagaaccttttccactacctgaagataaaagtcaaggaaatatcaacaatcctactccaggtccagttcctgttccaggtcccaaaagccatccttctgcatcctcgggcaaactgctgcttccacagtttgggatggtcatcattttaatcagtgtttctgctataaatctctttgttgctctgtag

SEQ ID NO: 7037 - DNA, 300 bp, Artificial Sequence
  Synthetic polypeptide
ggttgggcatggtggctcacgcctgtaatcccagcgctttggaaggccgaggtgagaaaaaccagaagcttgaagaccatagtgagaaaaactggaagcttgaagaccatggtgagaaaaaccagaagcttgaagaccatggtgtgaaaatccttgaacccacccaaatacctggaatgaaaattccagaaccttttccactacctggaataaaaatgatacaactgaatgaaaaacctgaagataaaagtcaaggaaatatcaacaatcctactccaggtccagttcctgttccaggtc

SEQ ID NO: 7038 - DNA, 1084 bp, Artificial Sequence; identical to SEQ ID NO: 580
  Synthetic polypeptide

SEQ ID NO: 7039 - DNA, 530 bp, Artificial Sequence
  Synthetic polypeptide
tccctgtgctctagccatgccaggcctcttgtgtcatcaaatctgcctaattcttgcccatctcaggcattcagtacttgtattttcttttgcctacaatatttttggcatagctgactcatctttcactttcagtctgtcatctcctcaaagagatactctgatcatgctatctaaacaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaacccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaa

SEQ ID NO: 7040 - DNA, 299 bp, Artificial Sequence
  Synthetic polypeptide
tccctgtgctctagccatgccaggcctcttgtgtcatcaaatctgcctaattcttgcccatctcaggcattcagtacttgtattttcttttgcctacaatatttttggcatagctgactcatctttcactttcagtctgtcatctcctcaaagagatactctgatcatgctatctaaacaatcatttggggaagaatctacagttgctgatggacagagtggatgaaatgagccaagatatagttaaatacaacacatacatgaggaatactagtaaacaacagcagcagaaacatcag

SEQ ID NO: 7041 - DNA, 428 bp, Artificial Sequence
  Synthetic polypeptide
ggtggctcatgcctgtaatcccagcacttcaagaggctttggcggaagaatcgcttgagcccaggagtttgagaccagcctgggcaacacaagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatag

SEQ ID NO: 7042 - DNA, 435 bp, Artificial Sequence
  Synthetic polypeptide
ggtggctcatgcctgtaatcccagcacttcaagaggctttggcggaagaatcgcttgagcccaggagtttgagaccagcctgggcaacacaagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttga

SEQ ID NO: 7043 - DNA, 657 bp, Artificial Sequence
  Synthetic polypeptide
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagcaggctagtgctctcagcttcccggcccccccttccaggccgctgccgcctgaccctgtgtccaagagactccagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctga

SEQ ID NO: 7044 - DNA, 729 bp, Artificial Sequence
  Synthetic polypeptide
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagcaggctagtgctctcagcttcccggcccccccttccaggccgctgccgcctgaccctgtgtccaagagactccaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctga

SEQ ID NO: 7045 - DNA, 654 bp, Artificial Sequence
  Synthetic polypeptide
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctga

SEQ ID NO: 7046 - DNA, 456 bp, Artificial Sequence
  Synthetic polypeptide
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagtctcaggggccagccaagcccccacccccaaggaagccactgcctgccgacccccagggccggtgcccatcgggtgacctgcccggcccaggggctggaatcccgcccctag

SEQ ID NO: 7047 - DNA, 528 bp, Artificial Sequence
  Synthetic polypeptide
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacaggctagtgctctcagcttcccggcccccccttccaggccgctgccgcctgaccctgtgtccaagagactccagtctcaggggccagccaagcccccacccccaaggaagccactgcctgccgacccccagggccggtgcccatcgggtgacctgcccggcccaggggctggaatcccgcccctag

SEQ ID NO: 7048 - DNA, 726 bp, Artificial Sequence
  Synthetic polypeptide
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaaggctagtgctctcagcttcccggcccccccttccaggccgctgccgcctgaccctgtgtccaagagactccaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctga

SEQ ID NO: 7049 - DNA, 606 bp, Artificial Sequence
  Synthetic polypeptide
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagcaggctagtgctctcagcttcccggcccccccttccaggccgctgccgcctgaccctgtgtccaagagactccaggctgagctggctgaccgacccaatccccctacccgccctctgcccgctgacccggtggtgagaagcccgaaggtaacggtggggggagagaagggcacggcctctccccccacctag

SEQ ID NO: 7050 - DNA, 531 bp, Artificial Sequence
  Synthetic polypeptide
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaaggctgagctggctgaccgacccaatccccctacccgccctctgcccgctgacccggtggtgagaagcccgaaggtaacggtggggggagagaagggcacggcctctccccccacctag

SEQ ID NO: 7051 - DNA, 582 bp, Artificial Sequence
  Synthetic polypeptide
gagcaaagtcctatcaactcactatgccttggtttccccatctgtaaacgcagggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctga

SEQ ID NO: 7052 - DNA, 367 bp, Artificial Sequence; identical to SEQ ID NO: 548
  Synthetic polypeptide

SEQ ID NO: 7053 - DNA, 3274 bp, Artificial Sequence
  Synthetic polypeptide
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctgcctttccacattacggatgtaacttttatgggttcagaaaatggtcttgcacagaagcatcgaacacctcgccgacgatgtcagcagcccaaaatgctgagtag

SEQ ID NO: 7054 - DNA, 3544 bp, Artificial Sequence
  Synthetic polypeptide
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcagcctggagaggatatgatgctcggaggaaatttaagaaaataagcaacagaaggaatgagtctgctgctcataatcaagcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctggttcagaaaatggtcttgcacagaagcatcgaacacctcgccgacgatgtcagcagcccaaaatgctgagtagccctgaggacaccatgtactataaccagttaaatggaactctagaatatcaagggagcaagaggaagccaagaaaacttggccaaatcaaagtacttgatggggaagatgaatattacaaatctctgtcaccagtggactgtatccctgaggagaacaactcagcccacccttcctttttttcttcatcctcaaaaggagactcttttgctcaacattaa

SEQ ID NO: 7055 - DNA, 3463 bp, Artificial Sequence
  Synthetic polypeptide
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcaggggacacttcaaaccaaagcagtgggccacattcccccgtcgcagcaggtacgaggggaagtgccgaggttcaagactgcagcgagcctggtgaccataaagttctcaggggctctgtacatcgtaggagccattcacaagcagaatccaacaatggccgtacacagacttcaagcaactctcctgctgtcacagagaaaaatgggcattcacaagcccagagttctccaaaagggtgcgatatcttcgcaggacatgcaaacaagcactcggtttctgggactgatttgctgtcttctcggatatgccatcctgctccagatcagcaaggattgagtctctggggagcccctcaaaagcctggttcagaaaatggtcttgcacagaagcatcgaacacctcgccgacgatgtcagcagcccaaaatgctgagtagccctgaggacaccatgtactataaccagttaaatggaactctagaatatcaagggagcaagaggaagccaagaaaacttggccaaatcaaagtacttgatggggaagatgaatattacaaatctctgtcaccagtggactgtatccctgaggagaacaactcagcccacccttcctttttttcttcatcctcaaaaggagactcttttgctcaacattaa

SEQ ID NO: 7056 - DNA, 2807 bp, Artificial Sequence
  Synthetic polypeptide
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggatacaattatccatcagttgcagaaacgttatgcagacttgctaatttacacatatgttggagacatcttaattgccttaaaccccttccagaatctaagcatatactctccacagttttccagactttatcatggggtgaaacgcgcctccaatcccccccacatatttgcatcagcagatgctgcttaccagtgcatggttactctcagcaaagaccagtgcattgtcatcagcggagagagtggctctgggaagacagaaagcgcccacctgattgttcagcatttgactttcttgggaaaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgagagagaaaaattttcatatattttactatatttatgctggtcttcatcaccaaaagaagctttctgatttcagacttcctgaggaaaaacctcctaggtacatagctgatgaaactggaagggtgatgcacgacataacttccaaggagtcttacagaagacaattcgaagcaattcagcattgcttcaggattatagggttcacggacaaagaggtgcactcagtgtacagaattttggctgggattttgaatattgggaacattgagttcgcagctatttcctctcaacatcagactgataaaagtgaggtgcccaatgctgaagctttgcaaaatgctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatgtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttgataaatttgaagataatctacgatgcaaatacttctggaggcccaaaggagtggaactgtgctttggcattcagcattatgctggaaaggtattatatgatgcttctggggttcttgagaaaaatagagacactctccctgccgatgtggttgtggtcctgagaacgtcagaaaacaagcttcttcagcagctcttctcaatccctctgaccaaaacaggtaatttggcccagacaagagctaggataacagtggcctcaagttctttgcctccacatttcagtgctgggaaagccaaggtggacactctggaggtgatacggcatccggaagaaaccaccaacatgaagaggcaaactgtggcttcttacttccggtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtattattacttggcattcacagcacatcaaacacctcttgctagcaaagagagctgtgtggctatcttggaaaagtccagattagatcactgggtactgggaaaaacaaaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcag

SEQ ID NO: 7057 - DNA, 601 bp, Artificial Sequence
  Synthetic polypeptide
gtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggtactaaatatttag

SEQ ID NO: 7058 - DNA, 1317 bp, Artificial Sequence
  Synthetic polypeptide
gaccaggcatggtggctcacgcctgtaatcccagcactttgggaggccgaggagggcagatcacgaggtcaagagatcgagaccattctggctaacatgatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtga

SEQ ID NO: 7059 - DNA, 363 bp, Artificial Sequence
  Synthetic polypeptide
ctttagatatttgcagattccatttttcactcatcaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatgacccttacttttggtgatgtggttgctgttcgccactatgagaaggcataa

SEQ ID NO: 7060 - DNA, 465 bp, Artificial Sequence
  Synthetic polypeptide
ctttagatatttgcagattccatttttcactcatcaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatggtaagtaatgacaattctccattcttccttgtttttttctcctctccgcacacctctcacctccttccttcttcttccctcctccttccattcttcctccttccttccttctttaataatacatcactggcaaggttctttaactatatgtaa

SEQ ID NO: 7061 - DNA, 423 bp, Artificial Sequence; identical to SEQ ID NO: 6550
  Synthetic polypeptide

SEQ ID NO: 7062 - DNA, 414 bp, Artificial Sequence; identical to SEQ ID NO: 602
  Synthetic polypeptide

SEQ ID NO: 7063 - DNA, 434 bp, Artificial Sequence; identical to SEQ ID NO: 603
  Synthetic polypeptide

SEQ ID NO: 7064 - DNA, 1615 bp, Artificial Sequence
  Synthetic polypeptide
gaagaatcaaatagacgaaaaaaaaatgataaagggatgtcaccaccaatcccacagaaatacaaactaccatcagagaatactataaacacctctaagcaaataaactagtaaatctagaagaaatggataaattactggacgcatacaccctcccaagactaaaccaggaagaagttgaatctctgaatagaccaatgacaggctctgaaattgaggcaataattaatagcctaccaaccaaaaaaagtacaggaccagatggattcacagccaaattctaccagagggacaaggaggagctggtaccattccttctgaaactattccaatcgatagaaaaagagggaatcctccctaactcattttatgaggccagcatcatcctgataccaaagcctggcagagacacaacaaaaaaagagaattttagaccaatattcctgatgaacattgatgcaaaattccttaataaaatactggcaaaccaaatccagcagcacatcaaaaagcttatccaccatgatcaagtgggcttcatccctgggatgcaaggctggttcaacatatgcaaatcaatcaacgtaatccagcatataaacagaaccaaagacaaaaaccacatgattttctcaatagatgtagaaaaggcctttgacaaaattcaacagcccttcatgctaaaaactctcaataaattaggtattgatgggatgtatctcagaataataagagctatttatgacaaacccacagccaatatcatactgaatgggcaaaacctggaagcattccacttgaaaactggcacaagacagggatgccctctctcaccactcctattcaatgtagtgttggaagttctggccagggcaatcaggcaggagaaagaaataaagggcattcaattaggaaaagaggatgtcacactgtcccagtttgcagacgacgttattgtatatttagaaaaccccattgtgtcagcccaaaatctccttaagctgataagcaacttcagcaaagtctcaggatacaaaatcaatgtgcaaaaatcacaagcattcttatacaccaataacagacaaacagagagcaaatcatgagtgaactcccattcacaattgcttcaaagagaataaaatacctaggaatccaacttacaagggatgtgaaggacctcttaaaggggaactataaaccactgctcaatgaaataagaggacacaaacaaatggaagaatattccatgctcatgggtaggaagaatcaatatcgtgaaaatggccatactgcccaaggaataactgtgtttatcaatatttgggctcttcaccacaacccctatttctgggaagaccctcaggtctttaaccccttgagattctccagggaaaattctgaaaaaatacatccctatgccttcataccattctcagctggattaaggaactgcattgggcagcattttgccataattgagtgtaaagtggcagtggcattaactctgctccgcttcaagctggctccagaccactcaaggcctccccagcctgttcgtcaagttgtcctcaagtccaagaatggaatccatgtgtttgcaaaaaaagtttgctaa

SEQ ID NO: 7065 - DNA, 784 bp, Artificial Sequence; identical to SEQ ID NO: 6798
  Synthetic polypeptide

SEQ ID NO: 7066 - DNA, 569 bp, Artificial Sequence
  Synthetic polypeptide
ctcaacaaccagctcattgccatgcacatactcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttag

SEQ ID NO: 7067 - DNA, 270 bp, Artificial Sequence
  Synthetic polypeptide
ctcaacaaccagctcattgccatgcacatactcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaaca

SEQ ID NO: 7068 - DNA, 182 bp, Artificial Sequence
  Synthetic polypeptide
ctcaacaaccagctcattgccatgcacatactcttgtagtgagatttctgaccaaacggttcatctgggaatatgatcccaccctcgaatcaacctaccgacaccaagcaaccatcgatgatgaagttgtttccatggagatactagacactgctggtcaggtgaataaagagttcagctaa

SEQ ID NO: 7069 - DNA, 85 bp, Artificial Sequence
  Synthetic polypeptide
ctcaacaaccagctcattgccatgcacatactcttgtagtgagatttctgaccaaacggttcatctgggaatatgatcccaccct

SEQ ID NO: 7070 - DNA, 1797 bp, Artificial Sequence
  Synthetic polypeptide
tgaaaccaccttgctaaggttatgatggttagagaaatccaacacagctgactttatcttgcttctgaccccagaagctgactatctgctcattcctgggtgtaggtcaagctaactaaaaaggagtttagtttacagtttaactttaaagcaaggatgataatagtcccttcctgaaactggtccccttcttgcttgggaactgaaactgcatttgtaaaactaatgaaagtcaataagattagaattatgataagggcctgaattctgctaagtaataagcacagtgaagaagagataaccagccattgttccctagcttggttactgctggaggtcacaagatttgagataacatcaccactgtaaaccctaagatgggtttttgagatatttttcagacctttgcattctggtaaactgactgatgccatctggaccatgactcataccaaggaacagactcaactcgtcctgtgacccccacctagaaactgactcagcacgtgaagacagttccaacactccagtgatttcatctccaaccaatcagtagcatacattccctggccctcagcttgccaaattatccttaaaaaccctgggctccaagctttcgaggaggtggatttgagagatacctcccctccttctgctcagctgccttgcagtaattaaactctttctctgctgcaacacccctactgttctccgtgtattggcttttctgggcagcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaa

SEQ ID NO: 7071 - DNA, 1081 bp, Artificial Sequence
  Synthetic polypeptide
tgaaaccaccttgctaaggttatgatggttagagaaatccaacacagctgactttatcttgcttctgaccccagaagctgactatctgctcattcctgggtgtaggtcaagctaactaaaaaggagtttagtttacagtttaactttaaagcaaggatgataatagtcccttcctgaaactggtccccttcttgcttgggaactgaaactgcatttgtaaaactaatgaaagtcaataagattagaattatgataagggcctgaattctgctaagtaataagcacagtgaagaagagataaccagccattgttccctagcttggttactgctggaggtcacaagatttgagataacatcaccactgtaaaccctaagatgggtttttgagatatttttcagacctttgcattctggtaaactgactgatgccatctggaccatgactcataccaaggaacagactcaactcgtcctgtgacccccacctagaaactgactcagcacgtgaagacagttccaacactccagtgatttcatctccaaccaatcagtagcatacattccctggccctcagcttgccaaattatccttaaaaaccctgggctccaagctttcgaggaggtggatttgagagatacctcccctccttctgctcagctgccttgcagtaattaaactctttctctgctgcaacacccctactgttctccgtgtattggcttttctgggcagcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgc

SEQ ID NO: 7072 - DNA, 1059 bp, Artificial Sequence
  Synthetic polypeptide
tgaaaccaccttgctaaggttatgatggttagagaaatccaacacagctgactttatcttgcttctgaccccagaagctgactatctgctcattcctgggtgtaggtcaagctaactaaaaaggagtttagtttacagtttaactttaaagcaaggatgataatagtcccttcctgaaactggtccccttcttgcttgggaactgaaactgcatttgtaaaactaatgaaagtcaataagattagaattatgataagggcctgaattctgctaagtaataagcacagtgaagaagagataaccagccattgttccctagcttggttactgctggaggtcacaagatttgagataacatcaccactgtaaaccctaagatgggtttttgagatatttttcagacctttgcattctggtaaactgactgatgccatctggaccatgactcataccaaggaacagactcaactcgtcctgtgacccccacctagaaactgactcagcacgtgaagacagttccaacactccagtgatttcatctccaaccaatcagtagcatacattccctggccctcagcttgccaaattatccttaaaaaccctgggctccaagctttcgaggaggtggatttgagagatacctcccctccttctgctcagctgccttgcagtaattaaactctttctctgctgcaacacccctactgttctccgtgtattggcttttctgggcagcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaacccataggcatgaaatga

SEQ ID NO: 7073 - DNA, 909 bp, Artificial Sequence
  Synthetic polypeptide
tgaaaccaccttgctaaggttatgatggttagagaaatccaacacagctgactttatcttgcttctgaccccagaagctgactatctgctcattcctgggtgtaggtcaagctaactaaaaaggagtttagtttacagtttaactttaaagcaaggatgataatagtcccttcctgaaactggtccccttcttgcttgggaactgaaactgcatttgtaaaactaatgaaagtcaataagattagaattatgataagggcctgaattctgctaagtaataagcacagtgaagaagagataaccagccattgttccctagcttggttactgctggaggtcacaagatttgagataacatcaccactgtaaaccctaagatgggtttttgagatatttttcagacctttgcattctggtaaactgactgatgccatctggaccatgactcataccaaggaacagactcaactcgtcctgtgacccccacctagaaactgactcagcacgtgaagacagttccaacactccagtgatttcatctccaaccaatcagtagcatacattccctggccctcagcttgccaaattatccttaaaaaccctgggctccaagctttcgaggaggtggatttgagagatacctcccctccttctgctcagctgccttgcagtaattaaactctttctctgctgcaacacccctactgttctccgtgtattggcttttctgggcagcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatatt

SEQ ID NO: 7074 - DNA, 346 bp, Artificial Sequence
  Synthetic polypeptide
cccccagatgacatttggcaatgtttgggagacatctttggttgtcataactgtcgagctctactggcatctaaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactag

SEQ ID NO: 7075 - DNA, 1256 bp, Artificial Sequence
  Synthetic polypeptide
tgcagcatcttgagcctcactctagacctgaatcagaacctgcatttgaacaatatcccagaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaa

SEQ ID NO: 7076 - DNA, 342 bp, Artificial Sequence
  Synthetic polypeptide
tgatatggtttggctgtgtccccacccaaatttcatcttcaattgtagctcccataattctctcatgttgtgggagggacctggtgggagataattgaatcatgagggcagttttccccatgctgttctcgtggtagtgagtaagtctcacaagatctgatggttttataagaggttttccctttctctgggctctcatttctctctgtggtctgctgccacgattgtgaggcctccccagccacgcgaaactaacttgagagagatttgctgggataaggcgggacatttctttgatctcccggacttcttatcgtggaaggcaacaggtgtcacagcacg

SEQ ID NO: 7077 - DNA, 1516 bp, Artificial Sequence
  Synthetic polypeptide
tgatatggtttggctgtgtccccacccaaatttcatcttcaattgtagctcccataattctctcatgttgtgggagggacctggtgggagataattgaatcatgagggcagttttccccatgctgttctcgtggtagtgagtaagtctcacaagatctgatggttttataagaggttttccctttctctgggctctcatttctctctgtggtctgctgccacgattgtgaggcctccccagccacgcgaaactaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 7078 - DNA, 1444 bp, Artificial Sequence
  Synthetic polypeptide
tgatatggtttggctgtgtccccacccaaatttcatcttcaattgtagctcccataattctctcatgttgtgggagggacctggtgggagataattgaatcatgagggcagttttccccatgctgttctcgtggtagtgagtaagtctcacaagatctgatggttttataagaggttttccctttctctgggctctcatttctctctgtggtctgctgccacgattgtgaggcctccccagccacgcgaaactaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 7079 - DNA, 1312 bp, Artificial Sequence
  Synthetic polypeptide
tgatatggtttggctgtgtccccacccaaatttcatcttcaattgtagctcccataattctctcatgttgtgggagggacctggtgggagataattgaatcatgagggcagttttccccatgctgttctcgtggtagtgagtaagtctcacaagatctgatggttttataagaggttttccctttctctgggctctcatttctctctgtggtctgctgccacgattgtgaggcctccccagccacgcgaaactaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagtgggggaaatag

SEQ ID NO: 7080 - DNA, 1083 bp, Artificial Sequence
  Synthetic polypeptide
ggctgggtgcagtggttcacgcctgttaatcccagcactttgggaggccaaggcatagcccttttgtacctgcagttgtaccgggtcacatgtgaccaaacctacctgctccgatccctggattacgtaaaaagaacacttcggaatctgaatggccgcagggtcaccttcctctgtggggatgctggccccctggctgttggagctgtgatttatcacaaactcagaagtgactgtgagtcccaggaatgtgtcacaaaacttttgcagctccagagatcggttgtctgccaagaatcagaccttcctgatgagctgctttatggacgggcaggttatctgtatgccttactgtacctgaacacagagataggtccaggcaccgtgtgtgagtcagctattaaagaggtagtcaatgctattattgaatcgggtaagactttgtcaagggaagaaagaaaaacggagcgctgcccgctgttgtaccagtggcaccggaagcagtacgttggagcagcccatggcatggctggaatttactatatgttaatgcagccggcagcaaaagtggaccaagaaaccttgacagaaatggtgaaacccagtattgattatgtgcgccacaaaaaattccgatctgggaattacccatcatcattaagcaatgaaacagaccggctggtgcactggtgccacggcgccccgggggtcatccacatgctcatgcaggcgtacaaggtctttaaggaggagaagtacttgaaagaggccatggagtgtagcgatgtgatttggcagcgaggtttgctgcggaagggctacgggatatgccatgggactgctggcaacggctattccttcctgtccctttaccgtctcacgcaggataagaagtacctctaccgagcttgcaagtttgcagagtggtgtctagattacggagcacacgggtgccgcattcctgacagaccctattcgctctttgaaggcatggctggcgctattcactttctctctgatgtcctgggaccagagacatcacggtttccagcatttgaacttgactcttcgaagagggattaa

SEQ ID NO: 7081 - DNA, 1873 bp, Artificial Sequence
  Synthetic polypeptide
tgatatgtttggatttgtgtccccacctaaatctcatgatgaattgtaattcccaatgttgggggagggacctggtgggaggtgattggatcttggcggtggttttcccccttgctgttcttgtgacagtgagtgagttctcatgagatctgatggtttaaaagtgtgtggcacttccccattcactcactgtctctcctgccgtcacgtgaagatgtgcttgcttcccctttgcccttccaccgtaattgtgagtttcctgaggcctcaccagccatgcctcctgtacagcctgtggaactgtgagtcaattcaacctcttttcttcataaatcatgcattctcagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctga

SEQ ID NO: 7082 - DNA, 977 bp, Artificial Sequence
  Synthetic polypeptide
tgtgacagattgcattttcagaaaaatggccaaaatacctcccatcccaaatgctttcttgcaagtgactttgacactcatcccattatagatgtggagatctgtgtgctctccattggatctcggcaaggctgtgactggaggatgcaaagctttgtgactttcaaggcagatcataaatggcagtaagacttctacctcattctgttgggatgcttactctaaacccgaccaccttgtcaggaggaaacccagacagcccatggagaagcccatatggagaggagccaaggcccacagccctagccgagctcccagctgaaagccagtaccaatttgccagccttgaatcactgacgtttcaggatgtggccgtggacttcaccagagaggagtgggaccagctgtaccctgcccaaaagaacctctatcgagacgtgatgctggagaactacaggaatctagttgcactggggtatcagctttgtaagccagaggtaatcgcgcagttggagctagaggaagaatgggtgatagaaagagacagcctgctggatactcatccaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtga

SEQ ID NO: 7083 - DNA, 1592 bp, Artificial Sequence
  Synthetic polypeptide
tgtgacagattgcattttcagaaaaatggccaaaatacctcccatcccaaatgctttcttgcaagtgactttgacactcatcccattatagatgtggagatctgtgtgctctccattggatctcggcaaggctgtgactggaggatgcaaagctttgtgactttcaaggcagatcataaatggcagtaagacttctacctcattctgttgggatgcttactctaaacccgaccaccttgtcaggaggaaacccagacagcccatggagaagcccatatggagaggagccaaggcccacagccctagccgagctcccagctgaaagccagtaccaatttgccagccttgaatcactgacgtttcaggatgtggccgtggacttcaccagagaggagtgggaccagctgtaccctgcccaaaagaacctctatcgagacgtgatgctggagaactacaggaatctagttgcactggggtatcagctttgtaagccagaggtaatcgcgcagttggagctagaggaagaatgggtgatagaaagagacagcctgctggatactcatccagatggagaaaacagacccgaaatcaaaaagtcaaccacaagccagaatatttctgatgaaaatcaaacccatgagatgataatggagagactcgcaggagacagcttctggtactccatcctaggaggactctgggattttgattaccatccagagtttaaccaagaaaaccacaagagatatttaggacaagtaactttgacccacaaaaagatcacacaggagagaagccttgagtgtaataaatttgcagaaaactgtaatctgaactcaaaccttatgcagcagagaattccttccattaaaatacccctgaattctgacacacagggaaacagcatcaaacataattcagacttgatttactatcagggaaattatgtaagagagactccctatgaatatagtgagtgtggaaaaatcttcaatcaacatattcttcttactgatcatattcatactgcagagaaacccagtgagtgtgggaaggccttcagccacacctcatctcttagccagcctcagatgttgcttacaggagagaagccctataagtgtgatgaatgtggaaaaagattcagccagaggatacatctcattcaacatcagagaattcacacaggagaaaagccttttatatgcaatggatgtgggaaagccttccgtcagcattcatcctttactcaacatctgaggattcatactggagaaaagccctataaatgtaatcaatgtggtaaagcttttagccgcatcacatcccttactgaacatcatagacttcataccggagagaaaccttacgaatgtggtttctgtggcaaagccttcagtcagaggacacatctgaatcaacatgaaagaactcatacaggagagaaaccctataaatgtaatgaatgcgggaaagcctttagccagagtgcacaccttaatcaacacaggaaaatccatactcgggagaaattatgtgaatataaatgtgagcaaactgttcgccacagtccttcatttagcagcacataa

SEQ ID NO: 7084 - DNA, 999 bp, Artificial Sequence
  Synthetic polypeptide
gctgagtgtggtagctcatgcctgtaatcccagcactttgggaggctgaggcaggaaaatcacttgagcccaagagtttgagaccagcctggacaacaaagcaagactccatctctacaaagaataaataaataagttagccagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtga

SEQ ID NO: 7085 - DNA, 733 bp, Artificial Sequence
  Synthetic polypeptide
gctgagtgtggtagctcatgcctgtaatcccagcactttgggaggctgaggcaggaaaatcacttgagcccaagagtttgagaccagcctggacaacaaagcaagactccatctctacaaagaataaataaataagttagccagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatgg

SEQ ID NO: 7086 - DNA, 179 bp, Artificial Sequence
  Synthetic polypeptide
gcatttcttctaaaaatacaaaaatacatgatgtgcctgtggccctagctactcaggaagttgagtttcgtgtggctgatcaaagaaagaaggcatacgcagatttctacagaaactacgatgtcatgaaagattttgaggagatgaggaaggctggtatctttcagagtgtaaagtaa

SEQ ID NO: 7087 - DNA, 2025 bp, Artificial Sequence
  Synthetic polypeptide
ggccgtgcagggcggctcacgcctgtaatcccagcactttgggaggctgaggtgggcagatcacctgaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtga

SEQ ID NO: 7088 - DNA, 1542 bp, Artificial Sequence
  Synthetic polypeptide
ggccgtgcagggcggctcacgcctgtaatcccagcactttgggaggctgaggtgggcagatcacctgaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagatataa

SEQ ID NO: 7089 - DNA, 345 bp, Artificial Sequence
  Synthetic polypeptide
ggccgtgcagggcggctcacgcctgtaatcccagcactttgggaggctgaggtgggcagatcacctgaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaaggaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttga

SEQ ID NO: 7090 - DNA, 280 bp, Artificial Sequence
  Synthetic polypeptide
ggccgtgcagggcggctcacgcctgtaatcccagcactttgggaggctgaggtgggcagatcacctgaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaag

SEQ ID NO: 7091 - DNA, 279 bp, Artificial Sequence
  Synthetic polypeptide
ggccgtgcagggcggctcacgcctgtaatcccagcactttgggaggctgaggtgggcagatcacctgaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaa

SEQ ID NO: 7092 - DNA, 1022 bp, Artificial Sequence; identical to SEQ ID NO: 590
  Synthetic polypeptide

SEQ ID NO: 7093 - DNA, 347 bp, Artificial Sequence; identical to SEQ ID NO: 591
  Synthetic polypeptide

SEQ ID NO: 7094 - DNA, 1109 bp, Artificial Sequence; identical to SEQ ID NO: 592
  Synthetic polypeptide

SEQ ID NO: 7095 - DNA, 85 bp, Artificial Sequence; identical to SEQ ID NO: 601
  Synthetic polypeptide

SEQ ID NO: 7096 - DNA, 269 bp, Artificial Sequence; identical to SEQ ID NO: 600
  Synthetic polypeptide

SEQ ID NO: 7097 - DNA, 1248 bp, Artificial Sequence
  Synthetic polypeptide
gagaaagcacaggctctggcatcagaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagccatttcagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttga

SEQ ID NO: 7098 - DNA, 1083 bp, Artificial Sequence
  Synthetic polypeptide
gagaaagcacaggctctggcatcagaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagctattctactggattctag

SEQ ID NO: 7099 - DNA, 117 bp, Artificial Sequence
  Synthetic polypeptide
gagaaagcacaggctctggcatcagaaaatgttagcaaactcaagaaacttgaatatttgaatttagctttaaacaacattgaaaaaatagaaaacttggaagatgtcatctattga

SEQ ID NO: 7100 - DNA, 225 bp, Artificial Sequence
  Synthetic polypeptide
ggctgggcgtggtggctcacgcctgtaatcccagcactttgggaggctgaggcgggctgatcacaagagctaaaacgtcatcctctcttcagtgatgtggactgggaaaatctgcagcatcagactatgcctttcatcccccagccagatgatgaaacagatacctcctattttgaagccaggaatactgctcagcacctgactgtatctggatttagtctgtag

SEQ ID NO: 7101 - DNA, 287 bp, Artificial Sequence
  Synthetic polypeptide
cccactgctgtttaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtga

SEQ ID NO: 7102 - DNA, 281 bp, Artificial Sequence
  Synthetic polypeptide
cccactgctgtttaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagca

SEQ ID NO: 7103 - DNA, 634 bp, Artificial Sequence
  Synthetic polypeptide
tcatctgacctattactcagcttgcctgcctgccccatcctgcctcaggttccggtgttcctcctgccagcgaagttgggcttccgcccaagtgcagattctgtgccacacgtactgggagcactggacatcccagggtcaggtgcgtatgaggctctttggccaaaggtgccagaagtgctcctggtcccaatatgagatgcctgagttctcctcggatagcaccatgaggattctgagcaacctggtgcagcatatactgaagaaatactatggaaatggcacgaggaagtctccagaaatgccagtaatcctggaagtgtccctggaaggatcccatgacacagccaattgtgaggcatgcactttgggcatctgtggacagggcttaaaaagctgcatgacaaagccgtccaaatccctactcccccacctaaagactgggaattcctcacctggaattggtgctgtgtacctcgcaaaccaagccaagaaccagtcagctgaggcaaaagaggctaaggggagtgggtatgagaaattagggcccagtcgagacccagatccactgaacatctgtgtctttattttgctgcttgtatttattgtagtcaaatgctttacatcagaatga

SEQ ID NO: 7104 - DNA, 527 bp, Artificial Sequence
  Synthetic polypeptide
aataatattcatctcacatgcctatggtgaggattaactaagcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagaggaggacgacgacatgaaggaattggagaactgggctggatccatgtaa

SEQ ID NO: 7105 - DNA, 353 bp, Artificial Sequence
  Synthetic polypeptide
gccaggtgcaggggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaa

SEQ ID NO: 7106 - DNA, 811 bp, Artificial Sequence
  Synthetic polypeptide
ttcaagccttgccactcgttagccctgtgaccagggcacgtcacttgacctctctgatcctcagttccctcatctgtaaggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcattgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtga

SEQ ID NO: 7107 - DNA, 1340 bp, Artificial Sequence
  Synthetic polypeptide
aaagcctgagcttttgaatcagactacttgggttggagtcctggctcctatgctgaatagccttgaagagtttgggcaaggtactgaaccccacattcctctttcacaagattgtggacctgacagtgggcaacaacaaaactctcctggacattgacaacactcgcatgacactggatgacttcaggataaagtttgagatggagcaaaacctgcggcaaggagtggatgctgacatcaatggcctgcggcaggtgctggacaatctgaccatggagaagtctgacctggagatgcagtatgagactctgcaggaggagctgatggccctcaagaagaatcataaggaggagatgagtcagctgactgggcagaacagtggagatgtcaatgtggagataaacgttgctcctggcaaagatctcaccaagaccctcaatgacatgcgtcaggagtatgagcagctcattgctaagaacagaaaggacatcgagaatcaatatgagactcagataacccagatcgagcatgaggtatccagtagtggtcaggaggtgcagtccagtgccaaggaggtgacccagctccggcacggtgtccaggagttggagattgagctgcagtctcagctcagcaagaaagcagctctggagaagagcttggaagacacgaagaaccgctactgtggccagctgcagatgatccaggagcagatcagtaacttggaggcccagatcactgacgtccggcaagagatcgagtgccagaatcaggaatacagccttctgctcagcattaagatgcggctggagaaggaaatcgagacctaccacaacctccttgagggaggccaggaagactttgaatcctccggagctggaaaaattggccttggaggtcgaggaggaagtggaggcagttatggaagaggatccaggggaggaagtggaggcagctatggtggaggaggaagtggaggtggctatggtggaggaagtgggtccaggggaggaagtggaggcagctacggtggaggaagtggttctggaggaggtagtggaggtggctatggtggaggaagtggaggtggccatagcggaggaagtggaggtggtcatagtggaggaagtgggggcaactatggaggaggaagtggctctggaggaggaagtgggggtggctatggtggaggaagtgggtccaggggaggaagtggaggcagccatggtggaggaagtggttttggaggtgaaagtggaggcagctacggaggcggtgaagaagcgagtggaagtggtggcggctacggaggaggaagcggaaaatcatcccattcctag

SEQ ID NO: 7108 - DNA, 557 bp, Artificial Sequence
  Synthetic polypeptide
ctggggatttggaaacttggtcctgctcaatgctgctgctacttcttgtgtcactatgaacccatcttttggcctctctgagtctcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaa

SEQ ID NO: 7109 - DNA, 463 bp, Artificial Sequence
  Synthetic polypeptide
tagtcccagctaatcggagaaactcaggatgaaaaccgaagaagaggcccggactcatacagagattgaaatgttccttagaaaggagcagcagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtga

SEQ ID NO: 7110 - DNA, 1647 bp, Artificial Sequence; identical to SEQ ID NO: 6537
  Synthetic polypeptide

SEQ ID NO: 7111 - DNA, 70 bp, Artificial Sequence; identical to SEQ ID NO: 6538
  Synthetic polypeptide

SEQ ID NO: 7112 - DNA, 432 bp, Artificial Sequence; identical to SEQ ID NO: 6539
  Synthetic polypeptide

SEQ ID NO: 7113 - DNA, 1901 bp, Artificial Sequence
  Synthetic polypeptide
ccgggcgcagtggctcatgcctgtaatcccagcactttgggaggccgagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgaaggatccgtccctctctgacagttccactgttgggcttcagcgagaactttcaaaggcttccaaatctgatgctacttctggaatcctcaattcaaccaacatccagtcctga

SEQ ID NO: 7114 - DNA, 1739 bp, Artificial Sequence
  Synthetic polypeptide
ccgggcgcagtggctcatgcctgtaatcccagcactttgggaggccgagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtgcgagaactttcaaaggcttccaaatctga

SEQ ID NO: 7115 - DNA, 1859 bp, Artificial Sequence
  Synthetic polypeptide
ccgggcgcagtggctcatgcctgtaatcccagcactttgggaggccgagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgcgagaactttcaaaggcttccaaatctgatgctacttctggaatcctcaattcaaccaacatccagtcctga

SEQ ID NO: 7116 - DNA, 1616 bp, Artificial Sequence
  Synthetic polypeptide
ccgggcgcagtggctcatgcctgtaatcccagcactttgggaggccgagtgaggtgctggcggaggagtccatagtatgtctgcagaaagccctaaatcaccttcgggaaatatgggagctaattgggattccagaggaccagcggttacaaagaactgaggtggtaaagaagcatatcaaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtgcgagaactttcaaaggcttccaaatctga

SEQ ID NO: 7117 - DNA, 501 bp, Artificial Sequence
  Synthetic polypeptide
ccgggcgcagtggctcatgcctgtaatcccagcactttgggaggccgagtgaggtgctggcggaggagtccatagtatgtctgcagaaagccctaaatcaccttcgggaaatatgggagctaattgggattccagaggaccagcggttacaaagaactgaggtggtaaagaagcatatcaaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagct

SEQ ID NO: 7118 - DNA, 369 bp, Artificial Sequence
  Synthetic polypeptide
ccgggcgcagtggctcatgcctgtaatcccagcactttgggaggccgagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaattcacttggaatcttataacagtggtacgttgtcttattcaggaagaaggagagacgacca

SEQ ID NO: 7119 - DNA, 1946 bp, Artificial Sequence
  Synthetic polypeptide
tgtgcagaaaagagttaacatggcaaatctgagactgctaattatcagaaagcctggcttgaaaggctggtcctcggctggcctctgggaacttggctgataaaccctgataataacctttccctatatgagaagagtggctcagtgtgcctaaactatttgtacaagttgtgtggttatgctgaacacctggtttccttattggagtctgaaattttggtatgtactaggcagcgggtgcctatgtgaccagcccgcagtaatagcctttgacattgagtctccaatgagctttcgtggtagacaacacaacacattgcacgtgttgtcagcactcgctactgtgggaaggaagtgtgtcctgagtcactgcatacctggtttcttccaaacttctctccgtgtgtcttttccctgtgctgcaactcaatgaaaaactgattgcttatcaacgagaattccttgctttgaaagaacgtcttcgaatagctgaacacagaatctcacagcgctcttctgaattaaatacgattgtgcaacagttcaagcgtgtaggagcagaaacaaatggaagtaaggatgcgttgaataagttttcagataataccctaaagctgttaaaggagttaacaagcaaaaaatctcttcaagtgccaagtatttattatcatttgcctcatttattgaaaaatgaaggaagtcttcaacctgctgtacagattggcaacggaagaacaggagtttcaatagtcatgggcattcccacagtgaagagagaagttaaatcttacctcatagaaactcttcattcccttattgataacctgtatcctgaagagaagttggactgtgttatagtagtcttcataggagagacagatattgattatgtacatggtgttgtagccaacctggagaaagaattttctaaagaaatcagttctggcttggtggaagtcatatcaccccctgaaagctattatcctgacttgacaaacctaaaggagacatttggagactccaaagaaagagtaagatggagaacaaagcaaaacctagattactgttttctaatgatgtatgctcaagaaaagggcatatattacattcagcttgaagatgatattattgtcaaacaaaattattttaataccataaaaaattttgcacttcaactttcttctgaggaatggatgattctagagttttcccagctgggcttcattggtaaaatgtttcaagcgccggatcttactctgattgtagaattcatattcatgttttacaaggagaaacccattgattggctcctggaccatattctctgggtgaaagtctgcaaccctgaaaaagatgcaaaacattgtgatagacagaaagcaaatctgcgaattcgcttcagaccttcccttttccaacatgttggtctgcactcatcactatcaggaaaaatccaaaaactcacggataaagattatatgaaaccattacttcttaaaatccatgtaaacccacctgcggaggtatctacttccttgaaggtctaccaagggcatacgctggagaaaacttacatgggagaggatttcttctgggctatcacaccgatagctggagactacatcttgtttaaatttgataaaccagtcaatgtagaaagttatttgttccatagcggcaaccaagaacatcctggagatattctgctaaacacaactgtggaagttttgccttttaagagtgaaggtttggaaataagcaaagaaaccaaagacaaacgattagaagatggctatttcagaataggaaaatttgagaatggtgttgcagaaggaatggtggatccaagtctcaatcccatttcagcctttcgactttcagttattcagaattctgctgtttgggccattcttaatgagattcatattaaaaaagccaccaactga

SEQ ID NO: 7120 - DNA, 112 bp, Artificial Sequence
  Synthetic polypeptide
gctggacgtgttggcttatgcttgtaatcctgacactttgggaggccgagtggccgcaagaggaagaggacgtggaatgggacgtggaaacatctttcaaaagcgaagataa

SEQ ID NO: 7121 - DNA, 1905 bp, Artificial Sequence
  Synthetic polypeptide
ggccaggtgtggtggctcacgcctgtaatcccagcactttggtaggccaaggtgggtggatcacgaggtcaggagatccagaccatcctggctaacatggtgaaacctcacctctactagaaatacaaaaaatcagccgggcgtggtggtgggtgcctgtagtcccagctactccggaggctgaggcaagagaatggcgtgaacccgcgaggcggagcttgtgagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatga

SEQ ID NO: 7122 - DNA, 873 bp, Artificial Sequence; identical to SEQ ID NO: 6614
  Synthetic polypeptide

SEQ ID NO: 7123 - DNA, 207 bp, Artificial Sequence; identical to SEQ ID NO: 6615
  Synthetic polypeptide

SEQ ID NO: 7124 - DNA, 566 bp, Artificial Sequence; identical to SEQ ID NO: 869
  Synthetic polypeptide

SEQ ID NO: 7125 - DNA, 1905 bp, Artificial Sequence; identical to SEQ ID NO: 7121
  Synthetic polypeptide

SEQ ID NO: 7126 - DNA, 68 bp, Artificial Sequence
  Synthetic polypeptide
ggccaggcatggtggctcaagcctggaatcccagcactttgggatgctgagggcactgtgacctttga

SEQ ID NO: 7127 - DNA, 416 bp, Artificial Sequence
  Synthetic polypeptide
ggccaggcatggtggctcaagcctggaatcccagcactttgggatgctgagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcata

SEQ ID NO: 7128 - DNA, 514 bp, Artificial Sequence
  Synthetic polypeptide
ggccaggcatggtggctcaagcctggaatcccagcactttgggatgctgagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcac

SEQ ID NO: 7129 - DNA, 1743 bp, Artificial Sequence
  Synthetic polypeptide
ggccaggcatggtggctcaagcctggaatcccagcactttgggatgctgagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatga

SEQ ID NO: 7130 - DNA, 1349 bp, Artificial Sequence
  Synthetic polypeptide
ctgagcctgtttcctcacctggtaaatagattgtggcccagaagaaggtgacccgcccgctgctgctcaagtttggcaggaacgctggcaagtccaccatcacggtgatcgccgaggacatctcggggaacaacggctacgtggagctctccttccgggccaggaagctggacgacaaggacctcttcagcaagtccgaccccttcctggagctctacagggtcaacgacgaccagggcttgcagctggtgtacaggacggaggtggtgaagaacaacctgaacccggtgtgggaggccttcaaagtctctctgagttccctctgcagctgcgaggagacaaggcctctaaagtgcctggtctgggattacgactctcgaggaaagcacgacttcatcggagaattctctaccaccttcgaggagatgcagaaggcctttgaggaggggcaggcccagtgggactgtgtgaaccccaaatacaagcagaagagacgcagttataagaactcaggagtggtcgtcctggctgacctcaagttccacagggtgtactccttcctggactatatcatgggcggctgccagatccacttcaccgtggccattgacttcaccgcctccaatggagacccgcggaacagctgctccctgcactacatcaacccctaccagccgaacgagtacctgaaggcactggtgtccgtgggcgagatctgccaggactatgacagtgacaagaggttttccgctttggggtttggagcccggatccctcccaagtatgaggtgtcccatgactttgccatcaatttcaaccctgaggacgatgagtgtgaaggcatccagggcgtggtggaggcctaccagaactgcctgcccagggtccagctctacggccccaccaacgtggcgcccatcatctccaaggtggcacgcgtggcggcggccgaggagagcaccgggaaagcctctcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtga

SEQ ID NO: 7131 - DNA, 3717 bp, Artificial Sequence
  Synthetic polypeptide
ggacgggcgcgggggctgacgcctgtaatcccaacactttgggaggccgaggggtattccctcagcggatactacacccatccatttcaaggctatgagcacagacagctcaggtaccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcagaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatag

SEQ ID NO: 7132 - DNA, 3636 bp, Artificial Sequence
  Synthetic polypeptide
ggacgggcgcgggggctgacgcctgtaatcccaacactttgggaggccgaggggtattccctcagcggatactacacccatccatttcaaggctatgagcacagacagctcaggtaccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcagaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagagctccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagta

SEQ ID NO: 7133 - DNA, 1164 bp, Artificial Sequence
  Synthetic polypeptide
cttggcaggtggtgagctccccactgcaggctgtattcaggtgtggccggataactacgtggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaa

SEQ ID NO: 7134 - DNA, 376 bp, Artificial Sequence
  Synthetic polypeptide
cttggcaggtggtgagctccccactgcaggctgtattcaggtgtggccggataactacgtggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatg

SEQ ID NO: 7135 - DNA, 956 bp, Artificial Sequence
  Synthetic polypeptide
ccacactccttccccttaattctggtttgtcaagcctccacttagatgacatgtgaggaagccttctctgactcttcactcattgaagtctctgctgtattcatccagagctccctgtactttcccaacagtatcgctctttatattcatcgtgaatgtttaatttaactcttgttcactacaaagcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaa

SEQ ID NO: 7136 - DNA, 386 bp, Artificial Sequence; identical to SEQ ID NO: 6552
  Synthetic polypeptide

SEQ ID NO: 7137 - DNA, 1328 bp, Artificial Sequence; identical to SEQ ID NO: 783
  Synthetic polypeptide

SEQ ID NO: 7138 - DNA, 1325 bp, Artificial Sequence; identical to SEQ ID NO: 784
  Synthetic polypeptide

SEQ ID NO: 7139 - DNA, 2387 bp, Artificial Sequence
  Synthetic polypeptide
atatttaaaaattgtatagtatttagcaacaaaaaggaatgaacaattgatgctgtacacacagcaaattatacaaacctcaaggacaacatactcagtgaagaaaattcagtcaccaagggatacatactgcatgattccattcctacaatatttgcaaaataacttccttgtagagatgtagaacagattagtggttgctagcagttaagaatgagaaagagagagatggatgtggctatggagacatgacacaagggagtcttatgggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataa

SEQ ID NO: 7140 - DNA, 1478 bp, Artificial Sequence
  Synthetic polypeptide
atatttaaaaattgtatagtatttagcaacaaaaaggaatgaacaattgatgctgtacacacagcaaattatacaaacctcaaggacaacatactcagtgaagaaaattcagtcaccaagggatacatactgcatgattccattcctacaatatttgcaaaataacttccttgtagagatgtagaacagattagtggttgctagcagttaagaatgagaaagagagagatggatgtggctatggagacatgacacaagggagtcttatgggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggactctttggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataa

SEQ ID NO: 7141 - DNA, 2059 bp, Artificial Sequence
  Synthetic polypeptide
ttttagagcacgtcgccaagaaagtgaaaagacagtccacataatggaagaatatatttgcaaatcatgtatcttataacacccatgaatctagcctatgtaaagaaccgttacaaattaataataaaaagaaaaataacccagtttgaaaatggacgaggatctcagcagacatttctccaaagaatgtatacaagtggctgacaatcacatgaaaaaatgctcagcatcctgttatcagagaaattcaatcaaaaacacaatataccacttcacatgtactaggatggctgtaataaaagatataataaaaaatgatcctaaagatgtggagaaattggaatcctcatctgtggctcctgggaatataaaatggtaccaccactttggtaaacagtctggcagtttctcaaagtgataatcatgtagttgtcatatgatccagcaatttgactcctaggtatataccgaagagagatgagaaaatgtgtccacaaaaaacttgcacccagatgttcatagcagcgttatagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctga

SEQ ID NO: 7142 - DNA, 1378 bp, Artificial Sequence
  Synthetic polypeptide
aaattggtaccaggaatgaggtactgcctaaagatacctaaaaatgtggaagcaattttggaactgggtaatgggcagtggctggaacagtttggagggctcagaagaagataggaagatgtgggaaagtttggaacttcctagagacttgttgaatagttttgaccaaaattctgatagtgacatggacaatgaagtctaggctgaggtggtgtcagatggagatgaggaactttttgggaactggagcagaggtcactcttgttatatcttagcaaagagactggtggcattttgctcccaccctagaggtctgtggaattttgaacttgagaaagatgatttagggtatctggcagaagaaatttctaagcagcaaagcattcaagaagtgacctggcttttggtaaaagtgtatgcccatattcgttcacaaagaaaaaatcagaaattggaagttaaagggaagcagaccgtaaaagtttgaaaaatttgcagcctgaccatgcagtaaaaaagaaaaacctatcttctggcaataaattcaagctggctgcagatatttgcataagtaatgaggagcccaatgttaatggcaaagacaatgaggaaagtacctccagggcatgtcagagatcttcacagcagcccctcccatcgcaagcctggcagcctagtagggaaaaatggttttatgggtcaggccagggccctgctcctctgttcagccttgggacattgtaccctgcatcccagccactccagctccagccgtggctaaaaggggccaaggtacagctcaaactatggcttaagaggatgcaatccccaagtcttacagcttccacgtggtgttgggcctgctgctgtgcaaaagacgagagttcagctttgggagcctccatctagatttcagagaatgtatggagatgtctgaatgtccaagcagaaatctgctgcaggtcagagccctcaaggagaacctctgctacagcagtgcaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtga

SEQ ID NO: 7143 - DNA, 1393 bp, Artificial Sequence
  Synthetic polypeptide
aaattggtaccaggaatgaggtactgcctaaagatacctaaaaatgtggaagcaattttggaactgggtaatgggcagtggctggaacagtttggagggctcagaagaagataggaagatgtgggaaagtttggaacttcctagagacttgttgaatagttttgaccaaaattctgatagtgacatggacaatgaagtctaggctgaggtggtgtcagatggagatgaggaactttttgggaactggagcagaggtcactcttgttatatcttagcaaagagactggtggcattttgctcccaccctagaggtctgtggaattttgaacttgagaaagatgatttagggtatctggcagaagaaatttctaagcagcaaagcattcaagaagtgacctggcttttggtaaaagtgtatgcccatattcgttcacaaagaaaaaatcagaaattggaagttaaagggaagcagaccgtaaaagtttgaaaaatttgcagcctgaccatgcagtaaaaaagaaaaacctatcttctggcaataaattcaagctggctgcagatatttgcataagtaatgaggagcccaatgttaatggcaaagacaatgaggaaagtacctccagggcatgtcagagatcttcacagcagcccctcccatcgcaagcctggcagcctagtagggaaaaatggttttatgggtcaggccagggccctgctcctctgttcagccttgggacattgtaccctgcatcccagccactccagctccagccgtggctaaaaggggccaaggtacagctcaaactatggcttaagaggatgcaatccccaagtcttacagcttccacgtggtgttgggcctgctgctgtgcaaaagacgagagttcagctttgggagcctccatctagatttcagagaatgtatggagatgtctgaatgtccaagcagaaatctgctgcaggtcagagccctcaaggagaacctctgctacagcagtgcaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacacctactaaatcagaatctctgtggctgggactctgaattctgcatttttcatactttggcttctttcctcatctataaataa

SEQ ID NO: 7144 - DNA, 207 bp, Artificial Sequence
  Synthetic polypeptide
tgtgatttccacaggtgacagaaaccaggcagtgattcaactcgtatttgactttcacattctccagcaatgttcttcaatctgggaagggtagaaaattaaagaaaggtggtacctctaaatccaaaaactccaaatgtccaccagctccagtcacattggagatacagctgtggtttgctcctaagacccacccagcacacgtga

SEQ ID NO: 7145 - DNA, 661 bp, Artificial Sequence; identical to SEQ ID NO: 6609
  Synthetic polypeptide

SEQ ID NO: 7146 - DNA, 829 bp, Artificial Sequence; identical to SEQ ID NO: 6610
  Synthetic polypeptide

SEQ ID NO: 7147 - DNA, 889 bp, Artificial Sequence; identical to SEQ ID NO: 6611
  Synthetic polypeptide

SEQ ID NO: 7148 - DNA, 851 bp, Artificial Sequence
  Synthetic polypeptide
ggccgggtgtggtggctcacgcctgtagtcccagcactttgggaggccaagatgggtggatcacttgaggtggcacgcctgggcaacatggcgaaacaccatctctactaaaaatgcaaaaattagccaggtggcacgcgcctgtggtcccagctactcaggagactgaagcatgagaatcgcttgaacccaggaggcagaggttgcagtgagccgagatcacaccactgcactccagcctgggcaacagaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtga

SEQ ID NO: 7149 - DNA, 755 bp, Artificial Sequence
  Synthetic polypeptide
ggccgggtgtggtggctcacgcctgtagtcccagcactttgggaggccaagatgggtggatcacttgaggtggcacgcctgggcaacatggcgaaacaccatctctactaaaaatgcaaaaattagccaggtggcacgcgcctgtggtcccagctactcaggagactgaagcatgagaatcgcttgaacccaggaggcagaggttgcagtgagccgagatcacaccactgcactccagcctgggcaacagaggacatgttgtcttaacagattttgggctttgtaaagaaggaattgctatttctgacaccactaccacattttgtgggacaccagagcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtga

SEQ ID NO: 7150 - DNA, 1422 bp, Artificial Sequence
  Synthetic polypeptide
ggctgggtgcaatggctcacacctgtaatcccagcactttgggaggccaaggcgggcagatcacttgaggatgatggaccaacagcaagagacctgctagtacaatatgctacagggaagaaaagttccaaaaacaagaaaaagttggaaaaggcaatgaaagtgctcaagaaacaaaaaaagaagaaaaaaccagaggtgtttaacttttcagccattcacttgattcatgatccccaagattttgcggaaaaactactaaagcagcttgagtgctgtaaggagaggtttgaagtgaagatgatgctcatgaaccttatctccagattggtgggaattcatgagcttttcctcttcaatttctatccctttttgcaaaggtttctgcagccccaccaaagagaagtaaccaagatccttctgtttgctgcacaagcatctcatcacctagtacccccagagattattcaatcattgcttatgactgtggcaaacaattttgttaccgacaagaactctggagaagtcatgacagtaggaatcaatgctataaaggagataacagctcgatgtcctctggccatgactgaagaacttctccaagacctggctcagtataaaacacacaaggataagaatgtaatgatgtctgctagaactttgattcacctcttccgaacactgaatcctcagatgctgcagaagaaattccggggtaagcctacagaggcctccatagaagcaagagtacaagaatatggagaattagatgctaaagattacattccaggagcagaagttctggaagttgagaaagaagagaatgctgaaaatgatgaagatggatgggaaagtaccagtctcagtgaggaggaggatgctgatggtgaatggattgatgtgcaacactcttccgatgaagaacagcaagaaatctccaagaagctgaacagcatgcccatggaggagcggaaggccaaagctgcagccatcagcactagccgagttttaactcaggaagacttccagaaaatccgcatggcccaaatgagaaaagaacttgatgctgcccccgggaaatcccagaagaggaaatacattgaaatagacagtgatgaagagcccaggggtgaattactttctcttcgggacattgaacgccttcataaaaagccaaagtctgacaaagagacaagactagcaactgcaatggctggaaagacagaccgaaaagaatttgtgaggaagaaaaccaaaacaaatccattttccagttcgacaaataaagagaagaaaaaacagaagaactttatgatgatgcggtatagccagaatgtccggtcaaaaaataagcgttccttccgagaaaaacagttggcactacgagatgcacttttgaaaaagagaaaaagaatgaagtaa

SEQ ID NO: 7151 - DNA, 892 bp, Artificial Sequence
  Synthetic polypeptide
cagggcacctgcctgctggtttctgctgagcaggacaccagctgtgggactttaggcaggctgaggccccactctctctcagttttctgacctatataaactgctggagattcttggtgccaccattgagaactccaggattgtcctgcagatcgacaatgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctga

SEQ ID NO: 7152 - DNA, 371 bp, Artificial Sequence
  Synthetic polypeptide
cagggcacctgcctgctggtttctgctgagcaggacaccagctgtgggactttaggcaggctgaggccccactctctctcagttttctgacctatataaactgctggagattcttggtgccaccattgagaactccaggattgtcctgcagatcgacaatgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggcc

SEQ ID NO: 7153 - DNA, 119 bp, Artificial Sequence; identical to SEQ ID NO: 6582
  Synthetic polypeptide

SEQ ID NO: 7154 - DNA, 460 bp, Artificial Sequence
  Synthetic polypeptide
gggaagaaacagacctatgtcttgttctaattttaccattcattagtggtctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccataatggtgggtcgccccggatcccgttcagcaccttccagtttctctacacgtatattgccaaagtggatggggagatctctgcatcacatgtcagcaggatgctaaactacatggaacaggaagtaattggccctgatggtataatcacagtgaatgactttacccaaaaccccagggttcagctggagtaa

SEQ ID NO: 7155 - DNA, 210 bp, Artificial Sequence
  Synthetic polypeptide
gggaagaaacagacctatgtcttgttctaattttaccattcattagtggtctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctct

SEQ ID NO: 7156 - DNA, 170 bp, Artificial Sequence
  Synthetic polypeptide
gggaagaaacagacctatgtcttgttctaattttaccattcattagtggtctcaggttgctggcagactgatcatccgtgcagaggagctggcccagatgtggaaagtggtgaatctcccaacagatctgtttaatagtgtgatgaatgtgggtcgcttcacggaggaga

SEQ ID NO: 7157 - DNA, 520 bp, Artificial Sequence
  Synthetic polypeptide
cgtcctccgactgctgctccatcgccgccagccccggcgtctgcctctgtccgctctttctcgcgcccctttctggtctgcagcagatctgtgggctctactttccaatacactcagaaagccccaccgtttcccaccgccttgggttcctgctcccacgctcgcgcccttctctgcgttcacagcggcggccacggtgatttccttaaagctgaggcacgcaggtccgtgctgtgcgcagaaaccttcggctcttctccagctcacgcagacgaaaagccggagttctcccagggcctaccaggtaacaaatcggaagtacccaaaactgaaagaagtggatgatgtgcttggtggagcagctgcctgggagaatgttgactctactgcagagtcgtgtcccaaatgcgaacatcctcgtgcttacttcatgcagcttcagacccgctctgcagatgagccgatgaccaccttctacaagtgctgcaatgctcagtgtggacaccgctggagggattag

SEQ ID NO: 7158 - DNA, 604 bp, Artificial Sequence
  Synthetic polypeptide
ggctgtgcatggtgtctcacgcccataatcccagcactttgggagaccaagatccaaaaagttggcagctcttgcagaagccttaaaggaagtctcccttacaaaggcccagctggggttagaactggaagaactagaagcagcagcactgcttgtccaggaggaagaaactgcattaaaagcagcccattcagtttctgggcagcagacactttgctccagctctgaggcaagtgattcggaggactcagacagcagcgtgtcatctggaaacgaagactcaggctcagattcagaacaagatgaactcaaagatagtccatctgagacagtcagttctttgcaaggtccctttcttgaagaaagcagtgcctttcttattgttgatggtggagtacgcagaaacacagccatccaggagtctgatgccagtcagggaaagccacttgcctcttcctggcctcttggagtgtctgggcctctgatagaggagcttggggaacaactgaagactacagttcaggtttctgaacccaagggcaccactgctgtaaaccgcagcaatattcaggagagagacggctgtcagacaccaaataattga

SEQ ID NO: 7159 - DNA, 774 bp, Artificial Sequence
  Synthetic polypeptide
ttccactgtgctccacgaggctcagaccataacctgggatatttttcccacttttatatcatctcagtgctgtggaatggcttcctgctttggtgccttactcaatctctgttcctgggagcaccttttccaagctggcttcatggtttgctcagaattctcggggcggcacagttccagggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggcctaactgtgctgagccaagtgccaatggatggcaggaatgcctacataacagggaaaaatctattgatgcaagcacggtggttccatattcttgggatgatgatgttcatctggtcatctgcccatcagtataagtgccatgttattctcggcaatctcaggaaaaataaagcaggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaa

SEQ ID NO: 7160 - DNA, 441 bp, Artificial Sequence
  Synthetic polypeptide
ttccactgtgctccacgaggctcagaccataacctgggatatttttcccacttttatatcatctcagtgctgtggaatggcttcctgctttggtgccttactcaatctctgttcctgggagcaccttttccaagctggcttcatggtttgctcagaattctcggggcggcacagttccagggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaa

SEQ ID NO: 7161 - DNA, 718 bp, Artificial Sequence; identical to SEQ ID NO: 821
  Synthetic polypeptide

SEQ ID NO: 7162 - DNA, 1083 bp, Artificial Sequence
  Synthetic polypeptide
caaagaaatggaaagatggtgaaacaacctggaaaccataccttatcatgaacagcggaagtatcttgaaagtgtggccctgagaagaaaaaaactgaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaatctggttgcaatcccagtgtatgtcaaacataacatcagtttccgggacagtagttcccttggacgctttgaaataacggtgggacccaagcagacgatggggaagaccattgagggagtgactgtcaccagccagatgcccaagggggtcctgaacatgagccttactccatcacaggggacacacacattcgacccagtcacaaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggactcaaggtgaatcgtctggatatgtatggagaaaagtacaaaccctttaagggcataaaatacatgaccaaagctgggaagttccaagttcgaacctga

SEQ ID NO: 7163 - DNA, 648 bp, Artificial Sequence
  Synthetic polypeptide
caaagaaatggaaagatggtgaaacaacctggaaaccataccttatcatgaacagcggaagtatcttgaaagtgtggccctgagaagaaaaaaactgaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaaatgctgtcttgggatgtag

SEQ ID NO: 7164 - DNA, 244 bp, Artificial Sequence
  Synthetic polypeptide
caaagaaatggaaagatggtgaaacaacctggaaaccataccttatcatgaacagcggaagtatcttgaaagtgtggccctgagaagaaaaaaactgaggattattttggagtctgttcagagccagtgatcaaagacaatgtagttgtggtttatgaggtattggaagagatgcttgacaatggttttccattggctaccgagtcgaacattcttaaagaactcataaagcctcctaccatcc

SEQ ID NO: 7165 - DNA, 633 bp, Artificial Sequence
  Synthetic polypeptide
caaagaaatggaaagatggtgaaacaacctggaaaccataccttatcatgaacagcggaagtatcttgaaagtgtggccctgagaagaaaaaaactgaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaagtaa

SEQ ID NO: 7166 - DNA, 495 bp, Artificial Sequence
  Synthetic polypeptide
caaagaaatggaaagatggtgaaacaacctggaaaccataccttatcatgaacagcggaagtatcttgaaagtgtggccctgagaagaaaaaaactgaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaagtaa

SEQ ID NO: 7167 - DNA, 406 bp, Artificial Sequence
  Synthetic polypeptide
cctgccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggc

SEQ ID NO: 7168 - DNA, 1183 bp, Artificial Sequence
  Synthetic polypeptide
cctgccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatga

SEQ ID NO: 7169 - DNA, 3701 bp, Artificial Sequence; identical to SEQ ID NO: 6659
  Synthetic polypeptide

SEQ ID NO: 7170 - DNA, 3527 bp, Artificial Sequence; identical to SEQ ID NO: 6660
  Synthetic polypeptide

SEQ ID NO: 7171 - DNA, 457 bp, Artificial Sequence; identical to SEQ ID NO: 6661
  Synthetic polypeptide

SEQ ID NO: 7172 - DNA, 359 bp, Artificial Sequence; identical to SEQ ID NO: 6662
  Synthetic polypeptide

SEQ ID NO: 7173 - DNA, 588 bp, Artificial Sequence; identical to SEQ ID NO: 6663
  Synthetic polypeptide

SEQ ID NO: 7174 - DNA, 846 bp, Artificial Sequence
  Synthetic polypeptide
ctctctctgcctcagttccctcatctataaaatgggagtgttgggaggtttaaagaatacatgcgagtcacttatcgtggtctctggcacccagtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaa

SEQ ID NO: 7175 - DNA, 506 bp, Artificial Sequence
  Synthetic polypeptide
ctctctctgcctcagttccctcatctataaaatgggagtgttgggaggtttaaagaatacatgcgagtcacttatcgtggtctctggcacccagtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtattt

SEQ ID NO: 7176 - DNA, 672 bp, Artificial Sequence
  Synthetic polypeptide
ctctctctgcctcagttccctcatctataaaatgggagtgttgggaggtttaaagaatacatgcgagtcacttatcgtggtctctggcacccagtccacacgttccgaggcccacactggtgtgaatattgtgccaatttcatgtgggggctcatcgcccaaggggtccggtgctcaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaa

SEQ ID NO: 7177 - DNA, 708 bp, Artificial Sequence
  Synthetic polypeptide
ctctctctgcctcagttccctcatctataaaatgggagtgttgggaggtttaaagaatacatgcgagtcacttatcgtggtctctggcacccagtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaa

SEQ ID NO: 7178 - DNA, 4960 bp, Artificial Sequence
  Synthetic polypeptide
aaatctaattccattattttccttgttaaaatccttaagtagctcccttcgcctgtagaataaactcaggattcttactgagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtaatctctctctgtaa

SEQ ID NO: 7179 - DNA, 5068 bp, Artificial Sequence
  Synthetic polypeptide
aaatctaattccattattttccttgttaaaatccttaagtagctcccttcgcctgtagaataaactcaggattcttactgagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtga

SEQ ID NO: 7180 - DNA, 407 bp, Artificial Sequence
  Synthetic polypeptide
aaatctaattccattattttccttgttaaaatccttaagtagctcccttcgcctgtagaataaactcaggattcttactgagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaaggtataaaagaatctgggaaaactcttcagatttttaacattgaaatgaaaagtaaaatgaaggctcataccatgactgatgatgtcaccttttggaaatggatctctttgaatacgg

SEQ ID NO: 7181 - DNA, 1879 bp, Artificial Sequence
  Synthetic polypeptide
aaatctaattccattattttccttgttaaaatccttaagtagctcccttcgcctgtagaataaactcaggattcttactgagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtga

SEQ ID NO: 7182 - DNA, 334 bp, Artificial Sequence
  Synthetic polypeptide
aaatctaattccattattttccttgttaaaatccttaagtagctcccttcgcctgtagaataaactcaggattcttactgagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagcaaaatcgtgtggtgggagctatgcagctatattctgtagatag

SEQ ID NO: 7183 - DNA, 3133 bp, Artificial Sequence
  Synthetic polypeptide
ggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttatctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctga

SEQ ID NO: 7184 - DNA, 97 bp, Artificial Sequence
  Synthetic polypeptide
gagtgagagaggagagagggagaagagagcgcgagagagggggggctatttcctaggggcgccgatcaagaatacagtgcatttcgagtagggatgg

SEQ ID NO: 7185 - DNA, 326 bp, Artificial Sequence
  Synthetic polypeptide
gagtgagagaggagagagggagaagagagcgcgagagagggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgt

SEQ ID NO: 7186 - DNA, 2604 bp, Artificial Sequence
  Synthetic polypeptide
gagtgagagaggagagagggagaagagagcgcgagagagggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttag

SEQ ID NO: 7187 - DNA, 2604 bp, Artificial Sequence
  Synthetic polypeptide
gagtgagagaggagagagggagaagagagcgcgagagagggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcagcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaatgcggttaacctcgcagtactaaaactgaatgaacaaggcctgttggacaaattgaaaaacaaatggtggtacgacaaaggagagtgcggcagcgggggaggtgattccaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttag

SEQ ID NO: 7188 - DNA, 1079 bp, Artificial Sequence
  Synthetic polypeptide
ggccgggcgcggtggctcacacatgtaatcccagcactttgggaggctaaagcgggtggattacctgaggtcaggagtttgagaccagcctggcctacatggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacagcctccctgcgatttgatggggccctgaatgtggacttgacggaattccagaccaacctagtgccgtacccccgcatccacttccccctggccacctatgccccagtcatctcagctgagaaggcctaccacgagcagctgtctgtggccgagatcaccaatgcctgcttcgagccagccaatcaaatggtcaagtgtgaccctcgccacggcaagtacatggcctgctgcatgttgtacaggggggacgtggtccccaaagacgtcaacgcggccatcgccaccatcaagaccaagcgcaccatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggaccataagttcgatctcatgtatgccaagcgggcctttgtgcactggtacgtgggcgaaggcatggaagagggagagttctctgaggcccgcgaggacctggcagctctagagaaggattatgaagaggtgggcgtggattccgtggaagctgaggctgaagaaggcgaagaatactga

SEQ ID NO: 7189 - DNA, 658 bp, Artificial Sequence
  Synthetic polypeptide
gtgtcctattaggaactggcctgcacagcaggaggtgagtgactggcaagcgagcgaagcttcatctgtatttacagtcactccccattgctcgcattactgcccaagctctgcctcctgtctgatcagccatggcattggattcttataggagagtgaaccgtattgtgaacggcacatgtgagggatctaggttgcgtgcttcttatgagaatctgatgcctgatgatctgtcaccgtctcccatcaccaccagatgggaccgtctggttgcaggaaaataagctcagggctccaactgattctacattatgccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccac

SEQ ID NO: 7190 - DNA, 1999 bp, Artificial Sequence
  Synthetic polypeptide
gtgtcctattaggaactggcctgcacagcaggaggtgagtgactggcaagcgagcgaagcttcatctgtatttacagtcactccccattgctcgcattactgcccaagctctgcctcctgtctgatcagccatggcattggattcttataggagagtgaaccgtattgtgaacggcacatgtgagggatctaggttgcgtgcttcttatgagaatctgatgcctgatgatctgtcaccgtctcccatcaccaccagatgggaccgtctggttgcaggaaaataagctcagggctccaactgattctacattatgccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtag

SEQ ID NO: 7191 - DNA, 671 bp, Artificial Sequence
  Synthetic polypeptide
gtgtcctattaggaactggcctgcacagcaggaggtgagtgactggcaagcgagcgaagcttcatctgtatttacagtcactccccattgctcgcattactgcccaagctctgcctcctgtctgatcagccatggcattggattcttataggagagtgaaccgtattgtgaacggcacatgtgagggatctaggttgcgtgcttcttatgagaatctgatgcctgatgatctgtcaccgtctcccatcaccaccagatgggaccgtctggttgcaggaaaataagctcagggctccaactgattctacattatgccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaac

SEQ ID NO: 7192 - DNA, 739 bp, Artificial Sequence
  Synthetic polypeptide
gtgtcctattaggaactggcctgcacagcaggaggtgagtgactggcaagcgagcgaagcttcatctgtatttacagtcactccccattgctcgcattactgcccaagctctgcctcctgtctgatcagccatggcattggattcttataggagagtgaaccgtattgtgaacggcacatgtgagggatctaggttgcgtgcttcttatgagaatctgatgcctgatgatctgtcaccgtctcccatcaccaccagatgggaccgtctggttgcaggaaaataagctcagggctccaactgattctacattatgccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccc

SEQ ID NO: 7193 - DNA, 854 bp, Artificial Sequence; identical to SEQ ID NO: 6577
  Synthetic polypeptide

SEQ ID NO: 7194 - DNA, 2578 bp, Artificial Sequence
  Synthetic polypeptide
cttggaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataa

SEQ ID NO: 7195 - DNA, 2305 bp, Artificial Sequence
  Synthetic polypeptide
cttggaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataa

SEQ ID NO: 7196 - DNA, 1759 bp, Artificial Sequence
  Synthetic polypeptide
cttggaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataa

SEQ ID NO: 7197 - DNA, 353 bp, Artificial Sequence
  Synthetic polypeptide
tggtttctaaattgagtctctggacaggtgctggcctatggtaaggttttcactgacccaggccaaaataagaaaactaaaggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatga

SEQ ID NO: 7198 - DNA, 121 bp, Artificial Sequence
  Synthetic polypeptide
tggtttctaaattgagtctctggacaggtgctggcctatggtaaggttttcactgacccaggccaaaataagaaaactaaaggttagagccacagctgaaacaactacaaacaaaatatga

SEQ ID NO: 7199 - DNA, 1571 bp, Artificial Sequence; identical to SEQ ID NO: 6810
  Synthetic polypeptide

SEQ ID NO: 7200 - DNA, 549 bp, Artificial Sequence; identical to SEQ ID NO: 876
  Synthetic polypeptide

SEQ ID NO: 7201 - DNA, 277 bp, Artificial Sequence
  Synthetic polypeptide
ggctgggcgctatggttcacgcctgtaatcccagcactttgggaggcggaggcaggcagattgcttgagcctaggagttcaagagcagactggggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtag

SEQ ID NO: 7202 - DNA, 126 bp, Artificial Sequence
  Synthetic polypeptide
ggctgggcgctatggttcacgcctgtaatcccagcactttgggaggcggaggcaggcagattgcttgagcctaggagttcaagagcagactggggcacctgtgctggttgcacttgctttgattga

SEQ ID NO: 7203 - DNA, 286 bp, Artificial Sequence
  Synthetic polypeptide
ggtcgggcaccatagctcatgcttgtaatcccggcactttgggaggccaaggcaagtggatcaactgaggctggtgaacgaggtgttcaccatcgacgacaccctgcagaccctcaagctgcggctgcgggagacacaggacacgctgcagctgctggtcatgaccaagtgccggctggagcacgagctcgccatcaaggccaacaccctctgcatcgacaaggagaagtgcatgggcatgcgtaagaccttcccctgcaccccgcgcctggtgggccacacctga

SEQ ID NO: 7204 - DNA, 1079 bp, Artificial Sequence; identical to SEQ ID NO: 6652
  Synthetic polypeptide

SEQ ID NO: 7205 - DNA, 144 bp, Artificial Sequence
  Synthetic polypeptide
tcactgtctttgctctgccttcagcccagggcctgccagctcgctgatgtgcttctcctgcttgaaccagaagagcaatctgtactgcctgaagccgaccatctgctccgaccaggacaactactgcgtgactgtgtctgctag

SEQ ID NO: 7206 - DNA, 379 bp, Artificial Sequence
  Synthetic polypeptide
tcactgtctttgctctgccttcagcccagggcctgccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctga

SEQ ID NO: 7207 - DNA, 205 bp, Artificial Sequence
  Synthetic polypeptide
tcactgtctttgctctgccttcagcccagggcctgccagctcgctgatgtgcttctcctgcttgaaccagaagagcaatctgtactgcctgaagccgaccatctgctccgaccaggacaactactgcgtgactgtgtctgctagtgccggcattggtgagtgccaggcctcagaccgtgccttcctcccctggccatctccctag

SEQ ID NO: 7208 - DNA, 184 bp, Artificial Sequence
  Synthetic polypeptide
tcactgtctttgctctgccttcagcccagggcctgccagctcgctgatgtgcttctcctgcttgaaccagaagagcaatctgtactgcctgaagccgaccatctgctccgaccaggacaactactgcgtgactgtgtctgctagtgccggcattgcctcatttcccatgcagggaatctcgtga

SEQ ID NO: 7209 - DNA, 184 bp, Artificial Sequence
  Synthetic polypeptide
tcactgtctttgctctgccttcagcccagggcctgccagctcgctgatgtgcttctcctgcttgaaccagaagagcaatctgtactgcctgaagccgaccatctgctccgaccaggacaactactgcgtgactgtgtctgctagtgccggcattggtggctttgctggagggacagacagttga

SEQ ID NO: 7210 - DNA, 295 bp, Artificial Sequence
  Synthetic polypeptide
gactctggaattagactgcctgagatcaaattccaattccatgtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagc

SEQ ID NO: 7211 - DNA, 1077 bp, Artificial Sequence
  Synthetic polypeptide
gactctggaattagactgcctgagatcaaattccaattccatgtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgctccaggtccagttcctgttccaggtcccaaaagccatccttctgcatcctcgggcaaactgctgcttccacagtttgggatggtcatcattttaatcagtgtttctgctataaatctctttgttgctctgtag

SEQ ID NO: 7212 - DNA, 578 bp, Artificial Sequence
  Synthetic polypeptide
gactctggaattagactgcctgagatcaaattccaattccatgtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatc

SEQ ID NO: 7213 - DNA, 362 bp, Artificial Sequence
  Synthetic polypeptide
gactctggaattagactgcctgagatcaaattccaattccatgtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatat

SEQ ID NO: 7214 - DNA, 1110 bp, Artificial Sequence
  Synthetic polypeptide
gactctggaattagactgcctgagatcaaattccaattccatgtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgaagataaaagtcaaggaaatatcaacaatcctactccaggtccagttcctgttccaggtcccaaaagccatccttctgcatcctcgggcaaactgctgcttccacagtttgggatggtcatcattttaatcagtgtttctgctataaatctctttgttgctctgtag

SEQ ID NO: 7215 - DNA, 1143 bp, Artificial Sequence
  Synthetic polypeptide
gactctggaattagactgcctgagatcaaattccaattccatgtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctggaatgaaaattccagaaccttttccactacctgaagataaaagtcaaggaaatatcaacaatcctactccaggtccagttcctgttccaggtcccaaaagccatccttctgcatcctcgggcaaactgctgcttccacagtttgggatggtcatcattttaatcagtgtttctgctataaatctctttgttgctctgtag

SEQ ID NO: 7216 - DNA, 497 bp, Artificial Sequence
  Synthetic polypeptide
gactctggaattagactgcctgagatcaaattccaattccatgtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggct

SEQ ID NO: 7217 - DNA, 644 bp, Artificial Sequence
  Synthetic polypeptide
ggccgggtgtggtggttcatgcctctcatcccagcacttcaggaggctgaggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggcctaactgtgctgagccaagtgccaatggatggcaggaatgcctacataacagggaaaaatctattgatgcaagcacggtggttccatattcttgggatgatgatgttcatctggtcatctgcccatcagtataagtgccatgttattctcggcaatctcaggaaaaataaagcaggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaa

SEQ ID NO: 7218 - DNA, 677 bp, Artificial Sequence; identical to SEQ ID NO: 747
  Synthetic polypeptide

SEQ ID NO: 7219 - DNA, 674 bp, Artificial Sequence; identical to SEQ ID NO: 748
  Synthetic polypeptide

SEQ ID NO: 7220 - DNA, 711 bp, Artificial Sequence
  Synthetic polypeptide
ccttgccctgtgcgcctcctccgcgtggctgttcctgaatacgctggtgtctgttcgcatcttttagaatacgctggtgtcggtgcgcacagcgcttctcttagttctgaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagctatgtgttctcatttcacccaagaccattggccagtgcagggcatagaagattcattccacaaacttatactgagaagatatgagaaatgtggacatgataatttacaattaagaaaaggctgtaaaagtttgaatgagtgtaagttgcagaaaggaggttataatgaatttaatgaatgcttgtcaactacccagagcaaaatacttcagtgtaaagcaagtgtcaaagttgttagtaaattttcaaattcaaacaaacgtaagacaagacatactggagagaaacactttaaagaatgtggcaaatcatttcagaagttttcacacctaactcaacataagaattcttccatctctatgacaacaagcccattttag

SEQ ID NO: 7221 - DNA, 447 bp, Artificial Sequence
  Synthetic polypeptide
ccttgccctgtgcgcctcctccgcgtggctgttcctgaatacgctggtgtctgttcgcatcttttagaatacgctggtgtcggtgcgcacagcgcttctcttagttctgaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagaattcttccatctctatgacaacaagcccattttagctttctggagaatagcatctgagaaaagccaaagtgcctcagtttacagacagctcactcacagaagcagagccacctaa

SEQ ID NO: 7222 - DNA, 1530 bp, Artificial Sequence
  Synthetic polypeptide
ccttgccctgtgcgcctcctccgcgtggctgttcctgaatacgctggtgtctgttcgcatcttttagaatacgctggtgtcggtgcgcacagcgcttctcttagttctgaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagctatgtgttctcatttcacccaagaccattggccagtgcagggcatagaagattcattccacaaacttatactgagaagatatgagaaatgtggacatgataatttacaattaagaaaaggctgtaaaagtttgaatgagtgtaagttgcagaaaggaggttataatgaatttaatgaatgcttgtcaactacccagagcaaaatacttcagtgtaaagcaagtgtcaaagttgttagtaaattttcaaattcaaacaaacgtaagacaagacatactggagagaaacactttaaagaatgtggcaaatcatttcagaagttttcacacctaactcaacataaggtaattcatgctggagagaaaccctacacttgtgaagaatgtggcaaagcctttaaatggtctttaatatttaatgaacataagagaattcatactggagagaaaccttttacttgtgaagaatgtggcagcatctttaccacatcctcacactttgctaagcataaaataattcatactggagaaaaaccctataaatgtgaagaatgtggcaaagcctttaataggttcacaacccttactaaacataagagaattcatgctggagagaaacccatcacatgtgaagaatgtaggaaaatctttacctcatcctcaaactttgccaaacataagcgaattcatactggagagaaaccctacaaatgtgaagaatgtggcaaagcctttaataggtccacaacccttactaaacataagagaattcatactggagagaaaccctacacatgtgaagaatgtggcaaagcttttagacagtcctcaaaactgaatgaacataagaaagttcatactggagagcggccctacaaatgtgatgaatgtggcaaagcctttggacggtccagggtcctgaatgaacataaaaaaattcatactggagagaaaccctacaaatgtgaagaatgtggcaaagcctttagacggtccacagatcggagtcaacataagaaaattcatagtgcagataaaccctacaaatgtaaagaatgtgacaaagcctttaaacaattttcgctcctgagtcaacataagaaaattcatactgtagataaaccctacaaatgtaaagattgtgacaaagcctttaaacggttctcacacctgaataaacataagaaaattcatacttga

SEQ ID NO: 7223 - DNA, 1295 bp, Artificial Sequence
  Synthetic polypeptide
tggtatggtttggctgtgtccccacccaaatctcatcttggattcccatgtattgtgggagggacccggtgggaggtaactgaatcatgggggcaggcctttctcatgctgtttttgtgatagtgaacaagtctcatgagatctgatggttttgaaaaggggagtttccctgcacaagctctcttctcttgtctgcttccaggtgagacatgcctttcaccttctgccatgattgtgaggcctctccagccatgtggaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataa

SEQ ID NO: 7224 - DNA, 1235 bp, Artificial Sequence
  Synthetic polypeptide
tggtatggtttggctgtgtccccacccaaatctcatcttggattcccatgtattgtgggagggacccggtgggaggtaactgaatcatgggggcaggcctttctcatgctgtttttgtgatagtgaacaagtctcatgagatctgatggttttgaaaaggggagtttccctgcacaagctctcttctcttgtctgcttccaggtgagacatgcctttcaccttctgccatgattgtgaggcctctccagccatgtggaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataa

SEQ ID NO: 7225 - DNA, 590 bp, Artificial Sequence
  Synthetic polypeptide
tggtatggtttggctgtgtccccacccaaatctcatcttggattcccatgtattgtgggagggacccggtgggaggtaactgaatcatgggggcaggcctttctcatgctgtttttgtgatagtgaacaagtctcatgagatctgatggttttgaaaaggggagtttccctgcacaagctctcttctcttgtctgcttccaggtgagacatgcctttcaccttctgccatgattgtgaggcctctccagccatgtggaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaagtgaaataccactaa

SEQ ID NO: 7226 - DNA, 449 bp, Artificial Sequence
  Synthetic polypeptide
tggtatggtttggctgtgtccccacccaaatctcatcttggattcccatgtattgtgggagggacccggtgggaggtaactgaatcatgggggcaggcctttctcatgctgtttttgtgatagtgaacaagtctcatgagatctgatggttttgaaaaggggagtttccctgcacaagctctcttctcttgtctgcttccaggtgagacatgcctttcaccttctgccatgattgtgaggcctctccagccatgtggaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtga

SEQ ID NO: 7227 - DNA, 431 bp, Artificial Sequence
  Synthetic polypeptide
ggctgggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctag

SEQ ID NO: 7228 - DNA, 290 bp, Artificial Sequence
  Synthetic polypeptide
ggctgggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtaagtttttaa

SEQ ID NO: 7229 - DNA, 281 bp, Artificial Sequence
  Synthetic polypeptide
ggctgggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggta

SEQ ID NO: 7230 - DNA, 821 bp, Artificial Sequence
  Synthetic polypeptide
aggaaaaggcagacaacgaatttaaaaatggacaaaagagttgaacagacactgcctaaaaatgactaaccagatgtcaatgagcaggtgaagagttgtttgacaacatcagtcatcagagaaatgcaaatatgaaccacagtagacatgacccaccagcattgctaagaaggacgaccactgtaccaagtgctggtgaagatctggagcaaccacatctctcagtcacttctgataggagtgtcagttactaaaactgttttggaaaccatttgatagtttcaaatacagctgaacacacacacactctataacccagcatttgcaacacgtaagagtatgactatcagaaatacgtacatatgtttatcagaagatctataggaaagtgatcatagcagcacaattctagtaaccacaaactggaaactaacaaaaagcccaacagcaagataatgaacaaatacattatggaatgttcacatggtggaatactgtactgcagtgaaaatgagcaaactattgctacgcataacaacatggttggatctcacaaacatgatgctgaacaaaaggagcttgctgcccttgaatttcctccaaagaaactatttggaaataaggatgaacgtgtgattgctgagagacgaagtcacttagagaaatacctcagggactttttcagcgtgatgctccagtccgcaacatctcccctccacatcaacaaagtgggactgactctctcgaaacataccatttgtgagttttcaccattcttcaagaaaggagtctttgactacagcagccacgggacggggtag

SEQ ID NO: 7231 - DNA, 1358 bp, Artificial Sequence
  Synthetic polypeptide
ggccgggtgcagtggcccacacctgtaatcccagcactttggcaggccgagcttttttattaagctgtgctgatggcataaatggaacagttaactggaagaccagacaggccaacaattttattatcagcagaaaaatggctgctgggatgaaagatgtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtgagtgctaa

SEQ ID NO: 7232 - DNA, 333 bp, Artificial Sequence; identical to SEQ ID NO: 6583
  Synthetic polypeptide

SEQ ID NO: 7233 - DNA, 1256 bp, Artificial Sequence
  Synthetic polypeptide
ggccgggtgcagtggcccacacctgtaatcccagcactttggcaggccgagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctga

SEQ ID NO: 7234 - DNA, 1331 bp, Artificial Sequence
  Synthetic polypeptide
ggccgggtgcagtggcccacacctgtaatcccagcactttggcaggccgagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcaatggagtttcgctcctgttgcccaggctggagtgcaatggagcgatcttggctcactgcagcctccgcctcccaggaacttgccacatcagactcagattccccaacagcagactacaggtaaatggtatccctga

SEQ ID NO: 7235 - DNA, 1229 bp, Artificial Sequence
  Synthetic polypeptide
ggccgggtgcagtggcccacacctgtaatcccagcactttggcaggccgagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtcatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctga

SEQ ID NO: 7236 - DNA, 1298 bp, Artificial Sequence
  Synthetic polypeptide
ggccgggtgcagtggcccacacctgtaatcccagcactttggcaggccgagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtcatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggagattttcgtttgacaacttttcaaagatttgaggtaaatggtatccctgaagaaagaaaactgactgaagcaatgaatttataa

SEQ ID NO: 7237 - DNA, 1250 bp, Artificial Sequence
  Synthetic polypeptide
ggccgggtgcagtggcccacacctgtaatcccagcactttggcaggccgagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtgagtgctaa

SEQ ID NO: 7238 - DNA, 1530 bp, Artificial Sequence
  Synthetic polypeptide
aatttcatttccttccttcacagggttgttatgaactagactggtccaacaggaaagtatgatagatgtgaactggggcttcttttcaaccttttccggaagctctcaagctgttcttgtggataagacagagaatatgtactccaatgcaaagacttttggttgaattataactggctgaaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgaggctgtcaccttgaactgtgcccacagtttctgctcctactgtatcaatgaatggatgaagcggaagatagaatgccccatttgtcggaaggacattaagtccaaaacgtactctttggttctggacaattgcattaataagatggtaaataatctgagctcagaagtgaaagaacgacgaattgttctcattagggaacgaaaagcaaagagattgttctga

SEQ ID NO: 7239 - DNA, 369 bp, Artificial Sequence
  Synthetic polypeptide
aatttcatttccttccttcacagggttgttatgaactagactggtccaacaggaaagtatgatagatgtgaactggggcttcttttcaaccttttccggaagctctcaagctgttcttgtggataagacagagaatatgtactccaatgcaaagacttttggttgaattataactggctgaaggtgactgtaggacgaggatttggtgtcacataccaactggtatcaaaaatctgccccctgatgatttctcgaaaccactgtgttttgaagcagaatcctgagggccaatggacaattatggacaacaagagttttccttctgaaaaggcagaagattttacagcagcaggagagagattcctttaa

SEQ ID NO: 7240 - DNA, 342 bp, Artificial Sequence
  Synthetic polypeptide
aatttcatttccttccttcacagggttgttatgaactagactggtccaacaggaaagtatgatagatgtgaactggggcttcttttcaaccttttccggaagctctcaagctgttcttgtggataagacagagaatatgtactccaatgcaaagacttttggttgaattataactggctgaaggtgactgtaggacgaggatttggtgtcacataccaactggtatcaaaaatctgccccctgatgatttctcgaaaccactgtgttttgaagcagaatcctgagggccaatggacaattatggacaacaaggggaccaccagtttgtctaaggagaggtga

SEQ ID NO: 7241 - DNA, 1419 bp, Artificial Sequence
  Synthetic polypeptide
aatttcatttccttccttcacagggttgttatgaactagactggtccaacaggaaagtatgatagatgtgaactggggcttcttttcaaccttttccggaagctctcaagctgttcttgtggataagacagagaatatgtactccaatgcaaagacttttggttgaattataactggctgaaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgagcaaagagattgttctgaagaccgtgctctaagggcatttgaaagactgccaggtagtgcgagcctgagatggtctggaggattctctctagccgtgactccgctgctctga

SEQ ID NO: 7242 - DNA, 229 bp, Artificial Sequence
  Synthetic polypeptide
cacacactctctgcactgttcctaggtgagtcacctaacctccctgagtctcagtttcctcacctatacaatggggataatattaaatcttccacacaggatcagcataaggattaagttacgagaactggtcagcatgtgcatctgccctgacccccaccagagacctgacatcggatacgtgcaccaggtggccaagcagatgcacatctggatgtccagcacctga

SEQ ID NO: 7243 - DNA, 924 bp, Artificial Sequence
  Synthetic polypeptide
aggttctttgcagtagaattttctcagccaggaatgatcttcccccagatatttgcatggcttctttcacttagctgatctctgttctgatatcagctgcctagagagaattttcttgaccacattcaaagttagtggcctctccaccttggttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacaatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaa

SEQ ID NO: 7244 - DNA, 963 bp, Artificial Sequence
  Synthetic polypeptide
aggttctttgcagtagaattttctcagccaggaatgatcttcccccagatatttgcatggcttctttcacttagctgatctctgttctgatatcagctgcctagagagaattttcttgaccacattcaaagttagtggcctctccaccttggttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacaatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagaggggaagagaagacaaaacgagtctttcattcggtgtgaacttttctctttaattttaactgatttaacactttttgtgaattaa

SEQ ID NO: 7245 - DNA, 1723 bp, Artificial Sequence
  Synthetic polypeptide
gtgcggtggctcaagcctgtaatcccaacactttgggaggtcgaggcaggtggatcacgaggtcaggagttgaagaccagcctggccaacatagtgaaacctcatctctactaaaaatacaaaaaattagccaggcgtggtggcaggcacctgtagtcccagggtagatacaacaagaattgaatactccattcctttaagagaaaactgggcactaccatattttgcatgccaaattgctgcacttacaggctatttaaaaagcaacttaaatacttatggagagaggttttgctacttgttgatgagtgcttcaacttacacatttatgatgatgtgggagtatagccactatctcctgtttcttcaagcaatatctctattcctgctagataccttttcagtggagcaaagtgacaaggtttatgaagtttataaaatctacatattttccctctttctgggatatttactacagtttgagaatccagctttgttggtatctcctttattaagtttagtagcagccttaatgcttgctaagtgccttcagctgaatgtgaagaaaggaagttttgtagctaaaataataaaagtgattaatttttacttggtgtgtactctgacaataacattgaatattataatgaagatgtttgtcccacacaaagaaaatgggcacatgctgaaattccttgaagtaaaatttggactaaatatgaccaagaattttacaatgaattggctcctctgtcaagaatccctgcaggcaccatctcaagatttttttctgcgattgacacagtcttctttattacctttctacattctagtgttaattatttgttttctttctatgttgcaagttatttttaggaggattaatggtaagtccctgaaggaaactgttactcttgaagatggacgaattggagaaagaccagaaataatttatcatgtaattcacactattttattgggttctcttgcaatggttatagaaggcttgaagtacatctggattccttatgtgtgcatgttagcagcatttggtgtatgttctcccgaactttggatgacacttttcaagtggcttcgattaagaactgtacacccaatattgttggctcttattctgagcatggccgtgcctactataataggtctcagcttatggaaagagttttttcccagattaatgacagaattaatggaactacaggaattctatgacccagatacagtggaacttatgacctggataaaaaggcaagctccagttgcagctgtgtttgcagggagtccacagttaatgggtgcgattaaattatgcactggatggatggtgacaagtttgcctctttacaatgatgatgatcttctcaagagaaatgaaaatatctaccaaatctattcaaagcgatctgctgaggatatttataaaatactgacatcttacaaagctaattacctaattgtagaggatgctatctgcaatgaggtgggacccatgagaggctgtagggttaaagatttattagacattgcaaatggccacatggtttgtgaagaaggtgacaagctaacctactcaaaatatgggcgattttgtcatgaggtcaaaattaactattctccatatgtgaattatttcactagagtatactggaacagatcctactttgtatataaaatcaacactgtgatatccttccagtcttga

SEQ ID NO: 7246 - DNA, 849 bp, Artificial Sequence
  Synthetic polypeptide
gtgcggtggctcaagcctgtaatcccaacactttgggaggtcgaggcaggtggatcacgaggtcaggagttgaagaccagcctggccaacatagtgaaacctcatctctactaaaaatacaaaaaattagccaggcgtggtggcaggcacctgtagtcccagggtagatacaacaagaattgaatactccattcctttaagagaaaactgggcactaccatattttgcatgccaaattgctgcacttacaggctatttaaaaagcaacttaaatacttatggagagaggttttgctacttgttgatgagtgcttcaacttacacatttatgatgatgtgggagtatagccactatctcctgtttcttcaagcaatatctctattcctgctagataccttttcagtggagcaaagtgacaagctgaatgtgaagaaaggaagttttgtagctaaaataataaaagtgattaatttttacttggtgtgtactctgacaataacattgaatattataatgaagatgtttgtcccacacaaagaaaatgggcacatgctgaaattccttgaagtaaaatttggactaaatatgaccaagaattttacaatgaattggctcctctgtcaagaatccctgcaggcaccatctcaagatttttttctgcgattgacacagtcttctttattacctttctacattctagtgttaattatttgttttctttctatgttgcaagttatttttaggaggattaatggtaagtccctgaaggaaactgttactcttgaagatggacgaattggagaaagaccagaaataatttatcatgtaattcacactattttattggg

SEQ ID NO: 7247 - DNA, 3556 bp, Artificial Sequence
  Synthetic polypeptide
ccaggcacagtggctcactcctgtagtcctagcactctgggaggccaaggcagatgtattgcttgagctcaggagtttgagaccagcctgactaacatggtgaaacccgtctctactaaatatgaaaaattagctgggtgatatggcccacgtctgtaatcccagctacttgggagactgagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatga

SEQ ID NO: 7248 - DNA, 3913 bp, Artificial Sequence
  Synthetic polypeptide
ccaggcacagtggctcactcctgtagtcctagcactctgggaggccaaggcagatgtattgcttgagctcaggagtttgagaccagcctgactaacatggtgaaacccgtctctactaaatatgaaaaattagctgggtgatatggcccacgtctgtaatcccagctacttgggagactgagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagattcaactagcctatcaaaaatcttggatacagttcattcttgtgaaagagcaagggaacttcaaaaagatcactgtgaacaacgtacaggaaaaatggaacaaatgaaaaagaagttttgtgtactgaaaaagaaactgtcagaagcaaaagaaataaaatcacagttagagaaccaaaaagttaaatgggaacaagagctctgcagtgtgagattgactttaaaccaagaagaagagaagagaagaaatgccgatatattaaatgaaaaaattagggaagaattaggaagaatcgaagagcagcataggaaagagttagaagtgaaacaacaacttgaacaggctctcagaatacaagatatagaattgaagagtgtagaaagtaatttgaatcaggtttctcacactcatgaaaatgaaaattatctcttacatgaaaattgcatgttgaaaaaggaaattgccatgctaaaactggaaatagccacactgaaacaccaataccaggaaaaggaaaataaatactttgaggacattaagattttaaaagaaaagaatgctgaacttcagatgaccctaaaactgaaagaggaatcattaactaaaagggcatctcaatatagtgggcagcttaaagttctgatagctgagaacacaatgctcacttctaaattgaaggaaaaacaagacaaagaaatactagaggcagaaattgaatcacaccatcctagactggcttctgctgtacaagaccatgatcaaattgtgacatcaagaaaaagtcaagaacctgctttccacattgcaggagatgcttgtttgcaaagaaaaatgaatgttgatgtgagtagtacgatatataacaatgaggtgctccatcaaccactttctgaagctcaaaggaaatccaaaagcctaaaaattaatctcaattatgcaggagatgctctaagagaaaatacattggtttcagaacatgcacaaagagaccaacgtgaaacacagtgtcaaatgaaggaagctgaacacatgtatcaaaacgaacaagataatgtgaacaaacacactgaacagcaggagtctctagatcagaaattatttcaactacaaagcaaaaatatgtggcttcaacagcaattagttcatgcacataagaaagctgacaacaaaagcaagataacaattgatattcattttcttgagaggaaaatgcaacatcatctcctaaaagagaaaaatgaggagatatttaattacaataaccatttaaaaaaccgtatatatcaatatgaaaaagagaaagcagaaacagaaaactcatga

SEQ ID NO: 7249 - DNA, 2665 bp, Artificial Sequence
  Synthetic polypeptide
tttggtgccgtgacttggatcagggacctcccttgggagatcaatcccctgtcctcctgctctttgctctgtgagaaagatccacctacgacctcaggtcctcagaccgaccagcccaagaaacatctcaccaatttcaaatccggtaagcggcctctttttactgtcttctccaacctccctcactatccgtcaacctctttctcctttcaatcttggcgccacactgcagtctctcccttctcttaatttcaattcctttcattttctggtagagacaaaggagacatgttttatccgtggacccaaaactctggcgccggtcacggactgggaaggcagccttcccttggtgtttaatcattgcagggatgcctctctgattatctacccacgtttcaagagtgtcagaccacgcagggaagcctgccttggtccttcacccttagtggcaagtcccgcttttctggggaaggggcaagtacgccaacaccttctctccttgtctctaccccttctctgcttttgtggggaaagggcaagtaccccaaccccttctctccttgtctctaccccttctctgcttttctgggggaggggcaagtacccctcaaccccttctccttcacccttagcggcaagtcccgcttttctgggggaggggcaagcacccctcaacaccttctccttcacccttggtggcaagtccctcttttctatggggcaagaacccccaatcccttatttctgcaccccgacctcttatctctgtgccccaatcccttatttccatgccccaacctcttatctctatgccccaatcccttatttccgcaccccaacctcttatctctgtgccccaatcccttatttccatgccccaacctcttatctctatgccccaatcccttatttctgcaccccaacctcttatctctgtgccccaatcccttatttccacaccccaacctcttatctctgtgccccaatcccttatttccgtgccctgacccccctccctgcttttctggagggtaagaacccccaaatcccttccctccgtgtctctacactctcttttctctaggtttgcctccttcactatgggcaaccttccaccctccattcctccttcttctcccttagcctgtgttcttaagaacttaaaacctcttcaactctcacctgacctaaaatctaagtgtcttattttcttctgcaatgccgtttgaccccagtacaaactcaacagtagttccaaatagccggaaaatggcactttcaatttttccatcctacaagatctgaataattcttgtcgtaaaataggcaaatggtctgaggtgcctgacgtccaggcattattttacacatcagtcccttcctagtctctgtgcccagtgcaactcatcccaaatcttccttccttcccgcctgtcccctcagtcccaaccccaagcgtcgctgagtctttctaatcttccttttctacagacccatctgacctctcccctcctcgccaggccaagctaggtcccaattcttcctcagcctccactcctccaccctgtaatctttttatcgcctcccctcctcacacctggtccagcttacggtttaattccatgactagccctcccccacctgcccagcaatttactcttaaaaaggtggctggagccaaaggcatagtcgaggttaatgctcctttttctttaccccaaatcagaagggtttaggctctttttcatcagatataaaaacccagcccagttcatggctcgttcagcagcaaccctgagacgctttacagccctagaccctaaaaggtcaaaaggccatcttattctcaatatacattttattacccaatctgctcccaacattaaactccaaaaattagaatctggccctcaaaccccgcaacaggacttaacctcaccttcaaggtgtacaataataaaaaaaaaagtggcaattccttgcctccactgtgagacaaaccccagccacatctccagcacacaagaacttccaaacgcctaaaccgaagtgcccaggcgttcctccagaacctcctcccccaggagcttgctacaagtgccagaaatctgaccaccaggccaaggaatgcctgcagcccaggattcctcctaagccgtgtcccatctgtgcggggaccccactggaaattggactgttcaactcacctggcagccactcccagagcccctggaactctggcccaaggctctctgactgactccttggcttagcggctgaagactgatgctgcccgatcgcctcagaagccccctagaccatcacggatgccgagcttcgggtaactctcacagtggaaggactattccctgatataaccaggccctttaaaaagtcatttgatgtcaagcatggagtggcacatcaaatttgggattttggtgattgttttccgacacctccaaattatggaaaatactgtgtgagacctaaaaagccagcacaggaggccctgataaactacagtcgacgagggaaaggtgtcctaaagcatcttcatggacggtgcgattctgaaagcaaggtttgctcatctgaggattcagaagctgatcgatactccgattatggctggggaggaccctcatcgccatttaactga

SEQ ID NO: 7250 - DNA, 1238 bp, Artificial Sequence
  Synthetic polypeptide
ctcgccttcaggacttgggctctgtgaaggagaaatgcccgaagctacacagcggacctgtcagagccagcccacaactagggctttctggtacacagtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcagatttgaccacttcatcaagttcatctggtcctagagtttctggctcaccttgtcatcatagtgattctaattcttctgagaaacacatgtcacgagcctctcaaagagaaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttag

SEQ ID NO: 7251 - DNA, 1127 bp, Artificial Sequence
  Synthetic polypeptide
ctcgccttcaggacttgggctctgtgaaggagaaatgcccgaagctacacagcggacctgtcagagccagcccacaactagggctttctggtacacagtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttag

SEQ ID NO: 7252 - DNA, 834 bp, Artificial Sequence
  Synthetic polypeptide
cttgagtgtgggctggatttattgactttattctaaatatacagtgatgaaaagggataaaaggtgcagaactctggcagacactactataaccagttattcaaggttaatatcaccatcaataagtccgttgctataatatgccctatgacatgatgtgatgagaaaggcatttcttctttgtggtatttgtcccaaatatccataaccccagtataattatcagaaaagcataacacaaacttgacctgagggacattctacgaaatacttaaccagggcccctgaaaactgtcagggtcacaggaaataagaaaagtctgagaaactcttacagcccagaggagactaaggagacatggcaaataagtgtactgacacaccctggaaaggaacagaaagagaacattattagaaaagctgatgaaatccaaataggctggagtttagttagtagtatcataccaatgttggcttcttagttgtgacagatgtaccactatgaggtaagatgttaacaacagcagaaactggattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatga

SEQ ID NO: 7253 - DNA, 936 bp, Artificial Sequence
  Synthetic polypeptide
ggagagctgttggcgatttaggggacagcggggacaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaa

SEQ ID NO: 7254 - DNA, 840 bp, Artificial Sequence
  Synthetic polypeptide
ggagagctgttggcgatttaggggacagcggggacaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggtaccgaacaaccctcctgctcacatgtcccccagggtttggggctcctctgtcccccgtcccgtga

SEQ ID NO: 7255 - DNA, 69 bp, Artificial Sequence
  Synthetic polypeptide
ggagagctgttggcgatttaggggacagcggggacaggcccctccagccagcgtcaggtgcagaatggc

SEQ ID NO: 7256 - DNA, 229 bp, Artificial Sequence
  Synthetic polypeptide
ggagagctgttggcgatttaggggacagcggggacaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggc

SEQ ID NO: 7257 - DNA, 643 bp, Artificial Sequence
  Synthetic polypeptide
ggagagctgttggcgatttaggggacagcggggacaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcag

SEQ ID NO: 7258 - DNA, 959 bp, Artificial Sequence
  Synthetic polypeptide
ccttgcagattaaggtgtggtccctggaccatgcccaacggcataggcagcacttgaaaactggctaaaaacgcagactctcaggccccgggccagagctactgaatcaaaatctgcattttaacaaggttcccaggtttctttttggagacaggcccttttggtgggtccatgagtctggttactacagccaggctccagcccaggttcaccagttcccctcttcttgtgagactggtccaggcagcccttctggacactgcatgatcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctga

SEQ ID NO: 7259 - DNA, 649 bp, Artificial Sequence
  Synthetic polypeptide
ccttgcagattaaggtgtggtccctggaccatgcccaacggcataggcagcacttgaaaactggctaaaaacgcagactctcaggccccgggccagagctactgaatcaaaatctgcattttaacaaggttcccaggtttctttttggagacaggcccttttggtgggtccatgagtctggttactacagccaggctccagcccaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaa

SEQ ID NO: 7260 - DNA, 761 bp, Artificial Sequence
  Synthetic polypeptide
ggccaggtgcggtggctcgcgcttacattcctagcactttgggaggccaaggcgggcggatcacctgaggtcaggcgttggagaccagcctagccaacatgatgaaacctcgtctctactaaaaatacaaaaaattagctgggcgtggtggtgcgtgcttgtagtcccagacactccggaggtgaggcgggagaatcgcttgagcccgggaggtggaggttgcagtaagccaacaccgtgccactgcactacagcctgggcgacagggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtga

SEQ ID NO: 7261 - DNA, 675 bp, Artificial Sequence
  Synthetic polypeptide
ggccaggtgcggtggctcgcgcttacattcctagcactttgggaggccaaggcgggcggatcacctgaggtcaggcgttggagaccagcctagccaacatgatgaaacctcgtctctactaaaaatacaaaaaattagctgggcgtggtggtgcgtgcttgtagtcccagacactccggaggtgaggcgggagaatcgcttgagcccgggaggtggaggttgcagtaagccaacaccgtgccactgcactacagcctgggcgacagggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaag

SEQ ID NO: 7262 - DNA, 2534 bp, Artificial Sequence; identical to SEQ ID NO: 586
  Synthetic polypeptide

SEQ ID NO: 7263 - DNA, 2045 bp, Artificial Sequence
  Synthetic polypeptide
taatatgtttcagctgtgctcccacccaaactctcatcttgaattgtaatcatcataagccccacatgtgaagggagagagcaggttgagctaattgaatcatgggggaagtttccccatgctgttctcctgagagtgagtgagctctcacgagatctgatggttttataagtgtttgatggttcctcctgcgtttattctcctttctgctgccttgtgaagaagatgtcttgcttccccttcaccttctaccacaactataagtttcctgaggcctccccagccatgctgaattgctgtcatcaaccggccattcaatgacacctcaaagtgatttggactccagtagctctgaagaattctatcaagctgttcatcatgctgagcaaaccttcagaaagatggaaagttatttgaagcagcagcaactttgtgatgttatcctgattgttgggaaccgaaagatacctgcacataggcttgttctgagttcagtctccgactattttgcggccatgtttacaagtgatgtttgtgaagccaagcaagaggagatcaaaatggaaggcatagaccccaatgctctctgggaccttgtccaatttgcatatacaggctgcttggaattaaaagaggacaccattgagaaccttcttgctgcagcgtgccttcttcagcttccacaggtggtggaagtgtgctgccacttcctcatgaagcttttgcatccatctaactgtttaggaattcgagccttcgcagatgctcaaggatgcattgagttaatgaaggtggcccacagctacacaatggaaaacataatggaagttatcagaaatcaagagtttttactccttccagctgaggagctccataaactactggccagtgatgatgtcaatgttcctgatgaagaaaccatcttccatgcattgatgatgtgggtcaagtatgacatgcagagtagatgcaatgacctgagcatgcttcttgcctttataagactgccactgcttccaccacagatattggctgacctagaaaatcatgcattatttaagaatgatctggaatgtcaaaagctgattctagaagcaatgaaataccatctattgccagaaagaagaactttaatgcaaagtccgagaactaaacccagaaaatctacagtcggaactttgtatgctgtaggaggaatggataacaacaaaggagctacaactatagagaaatatgatctgagaacaaatctgtggatccaggcagggatgatgaatggcagaaggctgcagtttggtgtggctgttattgatgacaaactctttgtaattggaggtcgagatggcttaaagacattgaacactgttgaatgttacaatcccaaaaccaagacatggactgtcttaccaccaatgtcaacacacagacatggtctaggtgtaacagtacttgaaggccctatttatgctgtgggaggccatgatggctggagctatctgaatacagtggaaaggtgggatccacagagtcaacaatggacatttgtagccagtatgtcaattgctcggagcacagttggtgtagcagcattgaatggcaagttgtattcagttggaggtcgtgatggaagttcctgtttgagttcaatggaatattatgatcctcatacaaataagtggaacatgtgtgctcccatgtgtaagaggagagggggtgtcggagtggccacatgtgacggttttctttatgcagtaggaggtcatgatgctcctgcttcaaatcactgttcccggctactggattatgtagaaagatatgatcccaaaacagacacttggaccatggtggctcctttgagtatgcccagagatgctgttggggtctgtctccttggtgacagattatatgctgttggtggctatgatggacagacatacctcaacactatggaatcctatgacccacaaactaatgagtggacacagatggcttccttgaatattgggagagcaggtgcctgtgtggtagtcatcaagcaaccttga

SEQ ID NO: 7264 - DNA, 1720 bp, Artificial Sequence
  Synthetic polypeptide
gagggtgtcagaagcgggatctgaagtggagcttctagcgaccccaggagccctgagtgaatatgcaaggcacctgcaggacccactggtgtccattgatctctcagagcgctggagatcgtggcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtaaactgaaatgtgacgtctgtggcatggtttgcattgggcccaatgtgcttatggtacataaaaggagtcacactggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactag

SEQ ID NO: 7265 - DNA, 498 bp, Artificial Sequence
  Synthetic polypeptide
gagggtgtcagaagcgggatctgaagtggagcttctagcgaccccaggagccctgagtgaatatgcaaggcacctgcaggacccactggtgtccattgatctctcagagcgctggagatcgtggcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtgaacgccccttccactgtaaccagtgtgg

SEQ ID NO: 7266 - DNA, 400 bp, Artificial Sequence
  Synthetic polypeptide
gagggtgtcagaagcgggatctgaagtggagcttctagcgaccccaggagccctgagtgaatatgcaaggcacctgcaggacccactggtgtccattgatctctcagagcgctggagatcgtggcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcagtaagtcttcattttatgatttttttttgtgtgtgtgtgtctctccagcaacagactttaatttgttaggtctgtggggtcctctcacattgtggtatagctactgttatagattttgctaa

SEQ ID NO: 7267 - DNA, 1694 bp, Artificial Sequence
  Synthetic polypeptide
tttaaaaaaaactgaatccatgtaaaacaagtatttatatgcatgagttcataatactaaggagaaaaaaaaatcattacttactttcagagaatgctaatgaatagaattcgttattgttgaaaactgacaaaggaaaagaatcaagcacttgttctgcttttattataaatcagaacttcagagtaatcaaatggccgacaaggtgaattttctctttacagatgtattccagttaataaacagaggtctgataaagacatgtcatcactttgcaaccaccaagaaaaaaatgcatgtaggcaatgagcatccattttgagagcatcacagaaaggcattacatactttttgagagggagtgcctttccatccacatcggtcaagctggcatccagattggggacgcctgctgggaactctattgcctggaacatggaatccagccaaatggcgttgttcttgacactcaacaggatcagctggaaaatgcaaaaatggagcacacaaatgcatctttcgataccttcttctgtgagacaagagctgggaagcatgtgcctagagcactcttcgtggacttggagccaactgttatagatgggatccggacgggccagcaccgttcactcttccaccccgagcagctccttagcggaaaggaggatgctgctaacaattacgcgcgaggccgttactctgtggggtcggaggtcatcgaccttgtgctggagaggacccggaagctggcagaacagtgtggtggacttcagggatttttgattttccgaagctttggaggaggcactggttcagggtttacgtctctcttaatggagaggctcacaggagaatatagcagaaagactaagctggagttctcggtctacccagcccccaggatctccactgctgtggtagagccttataactctgtcctcaccacccactccaccacagagcacacggactgtaccttcatggtggacaacgaggccgtctatgatatatgccatcgtaaactcggtgttgaatgcccctctcatgccagcatcaatagattggtggttcaggtggtatcttccatcactgcctccctccggtttgaagggcccttgaatgtagacctaattgaattccagaccaacctggtaccttatccgagaatacatttccccatgacagccttcgcccccatcgtctctgctgacaaagcctaccatgagcagttctctgtgtcagacatcaccactgcctgctttgagtcctccaaccagctggtcaagtgtgatcctcggcttgggaagtacatggcctgctgcctactctatagaggggatgtggtccccaaggaagtgaatgcagcaatcgcagccacgaagtcgaggcactctgttcagtttgtagattggtgtccaactggtttcaaggtgggcatcaacaatcggccgcccacggtgatgccgggtggggacctggccaaagtccaccggtccatctgcatgctgagcaacaccacggcgattgtggaggcctgggcccgcctggaccacaagtttgacctcatgtacgccaagagagcatttctgcactggtacctcagagaaggcatggaagaagcagagttcttggaggccagggaagatctggcagccctggagagggactatgaggaagtggcgcaaagtttctga

SEQ ID NO: 7268 - DNA, 1163 bp, Artificial Sequence
  Synthetic polypeptide
ttcttctctccagcagccagaacagcctgtagctctttacaagcactgtgctctttcccatcttgaaggctttgctcccgctgcttcctctttgtgcagttacctctcttccactggataacagtcactcatcctttaagattcagttcaatgatgacttctttctggaagcctcttctgagccagccaccagactaggttgggtgttcctcttctgtgtcccatagtaccagtgtttacttctaatatttcataattgtctgataatggatctgccttaccagttctgcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataa

SEQ ID NO: 7269 - DNA, 893 bp, Artificial Sequence
  Synthetic polypeptide
ttcttctctccagcagccagaacagcctgtagctctttacaagcactgtgctctttcccatcttgaaggctttgctcccgctgcttcctctttgtgcagttacctctcttccactggataacagtcactcatcctttaagattcagttcaatgatgacttctttctggaagcctcttctgagccagccaccagactaggttgggtgttcctcttctgtgtcccatagtaccagtgtttacttctaatatttcataattgtctgataatggatctgccttaccagttctgcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgcattatgtatacatatacacgtcatatctga

SEQ ID NO: 7270 - DNA, 1235 bp, Artificial Sequence
  Synthetic polypeptide
ttcttctctccagcagccagaacagcctgtagctctttacaagcactgtgctctttcccatcttgaaggctttgctcccgctgcttcctctttgtgcagttacctctcttccactggataacagtcactcatcctttaagattcagttcaatgatgacttctttctggaagcctcttctgagccagccaccagactaggttgggtgttcctcttctgtgtcccatagtaccagtgtttacttctaatatttcataattgtctgataatggatctgccttaccagttctgcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatgcattatgtatacatatacacgtcatatctgactatggacgaacggtttattctgtgacagtcatacatctctgcagtcaaagaaaccgaggctcaaagaaattaggaaacagctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatat

SEQ ID NO: 7271 - DNA, 392 bp, Artificial Sequence
  Synthetic polypeptide
ttcttctctccagcagccagaacagcctgtagctctttacaagcactgtgctctttcccatcttgaaggctttgctcccgctgcttcctctttgtgcagttacctctcttccactggataacagtcactcatcctttaagattcagttcaatgatgacttctttctggaagcctcttctgagccagccaccagactaggttgggtgttcctcttctgtgtcccatagtaccagtgtttacttctaatatttcataattgtctgataatggatctgccttaccagttctgcgatattggtatcaacttgactgaccctatgttcagaggaatttataggggggttcaaaagcatcaagtttatgattacaggtggaaatctacaagacagtaa

SEQ ID NO: 7272 - DNA, 902 bp, Artificial Sequence
  Synthetic polypeptide
ttcttctctccagcagccagaacagcctgtagctctttacaagcactgtgctctttcccatcttgaaggctttgctcccgctgcttcctctttgtgcagttacctctcttccactggataacagtcactcatcctttaagattcagttcaatgatgacttctttctggaagcctcttctgagccagccaccagactaggttgggtgttcctcttctgtgtcccatagtaccagtgtttacttctaatatttcataattgtctgataatggatctgccttaccagttctgcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttggtacgttcttaggttgctttggtttttaacttttatttaa

SEQ ID NO: 7273 - DNA, 785 bp, Artificial Sequence
  Synthetic polypeptide
ttcttctctccagcagccagaacagcctgtagctctttacaagcactgtgctctttcccatcttgaaggctttgctcccgctgcttcctctttgtgcagttacctctcttccactggataacagtcactcatcctttaagattcagttcaatgatgacttctttctggaagcctcttctgagccagccaccagactaggttgggtgttcctcttctgtgtcccatagtaccagtgtttacttctaatatttcataattgtctgataatggatctgccttaccagttctgcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtg

SEQ ID NO: 7274 - DNA, 1401 bp, Artificial Sequence
  Synthetic polypeptide
ggaggtggatctgcccaccatagacctttggcagtatctgaagatctttagtagtcgcggctagggggctgctgctggcataggataatccaggcacatggcggcactgttgaccccaccttcacgagtcgatgcacgcaccttctctgtgagagtcaagtcagcagcgcgtatgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactga

SEQ ID NO: 7275 - DNA, 960 bp, Artificial Sequence
  Synthetic polypeptide
ggccgggcgcagtggctcacacctgtaatcccagcactttgggaggccgaggcgggcggatcatgagaaacttacacatgtccaaaaatgattgagatggagcaggcggaggcccagcttgctgagttagacctgctagccagtatgttccctggtgagaatgagctcatagtgaatgaccagctggctgtagcagaactgaaagattgtattgaaaagaagacaatggaggggcgatcttcaaaagtctactttactatcaatatgaacctggatgtatctgacgaaaaaatggcgatgttttctctggcctgtattcttccctttaaatacccggcagttctgcctgaaattactgtcagatcagtattattgagtagatcccagcagactcagctgaacacagatctgactgcattcctgcaaaaacattgtcatggagatgtttgtatactgaatgccacagagtgggttagagaacacgcctctggctatgtcagcagagatacttcatcttcacccaccacaggaagcacagtccagtcagttgacctcatcttcacgagactctggatctacagccatcatatctataacaaatgcaaaagaaagaatattctagagtgggcaaaggagctttccctgtctgggtttagcatgcctggaaaacctggtgttgtttgtgtggaaggcccacaaagtgcctgtgaagaattctggtcaagactcagaaaattaaactggaagagaattttaattcgccatcgagaagacattccttttgatggtacaaatgatgaaacggaaagacaaaggaaattttccatttttgaagaaaaagtgttcagtgttaatggagccaggggaaaccacatggactttggtcagctctatcagttcttaaacaccaaaggatgtggggatgttttccagatgttctttggtgtagaaggacaatga

SEQ ID NO: 7276 - DNA, 1148 bp, Artificial Sequence; identical to SEQ ID NO: 436
  Synthetic polypeptide

SEQ ID NO: 7277 - DNA, 1150 bp, Artificial Sequence
  Synthetic polypeptide
tgtctccccagatcatcttctcccattcttctcccactcctaccagatttatgccctccctgctccactggaactgccctggccaacctcaccagtgacctccatgtcgcccaatccaaggtcggtttttgaccttcatctggacctaacagtcgatcacctcctgctcctggaaatgcgcatgcaattcagctttcagaacaccactctcacattagctcccttcccatccaggtcctttgttggtttctcatctgctcaacctctggatgttgttcacaccagtgctctcctctaccagctaaactcacccgagtgatcttgtccggtctcatggctttaaatgccacctataggccatcatttcccaggtttatacctccagcctggactcttccctgaatccagactcataaattcatctaacttctcttggatgtctaatgcacttgtcaagatcagcacgagtccaataactctgttcttccctgcagacctgaccttctacccacatccgtgacagctcctttcttctagctgcccaggccccagcccagaggccctctacacagagacaaggctgcagtttgacgagacagccaagcacctccagaagctggaaagcaccaccagaaaggcagtttgtgcatctgtgaaagacttcaacaagagccaggccatcgagtcagtggaaaggaaaaagcaagagaaaaagcaagaacaagaggacaacttggccgagatcaccaacctcctgcgtggggacctgctctccgagaacccgcagcaggcagccagctccttcgggccccaccgcgtggtccctgaccgctggaagggcatgacccaggagcagctggagcagatccgcctagtccagaagcagcaaatccaggagaagctgaggctccaggaagaaaagcgccagcgagacctggactgggaccggcggaggattcagggggctcgcgccaccctgctgtttgagcggcagcagtggcggcggcagcgcgacctgcgcagagctctggacagcagcaacctcagcctggccaaggagcagcatttgcagaaaaaatatatgaatgaagtctatacaaatcaacccacgggagactatttcacacaatttaatacaggaagtcgataa

SEQ ID NO: 7278 - DNA, 163 bp, Artificial Sequence; identical to SEQ ID NO: 480
  Synthetic polypeptide

SEQ ID NO: 7279 - DNA, 104 bp, Artificial Sequence; identical to SEQ ID NO: 481
  Synthetic polypeptide

SEQ ID NO: 7280 - DNA, 1331 bp, Artificial Sequence; identical to SEQ ID NO: 550
  Synthetic polypeptide

SEQ ID NO: 7281 - DNA, 1028 bp, Artificial Sequence; identical to SEQ ID NO: 551
  Synthetic polypeptide

SEQ ID NO: 7282 - DNA, 1295 bp, Artificial Sequence; identical to SEQ ID NO: 553
  Synthetic polypeptide

SEQ ID NO: 7283 - DNA, 1322 bp, Artificial Sequence; identical to SEQ ID NO: 554
  Synthetic polypeptide

SEQ ID NO: 7284 - DNA, 1013 bp, Artificial Sequence; identical to SEQ ID NO: 555
  Synthetic polypeptide

SEQ ID NO: 7285 - DNA, 742 bp, Artificial Sequence; identical to SEQ ID NO: 6357
  Synthetic polypeptide

SEQ ID NO: 7286 - DNA, 590 bp, Artificial Sequence; identical to SEQ ID NO: 6358
  Synthetic polypeptide

SEQ ID NO: 7287 - DNA, 577 bp, Artificial Sequence; identical to SEQ ID NO: 6359
  Synthetic polypeptide

SEQ ID NO: 7288 - DNA, 430 bp, Artificial Sequence; identical to SEQ ID NO: 6360
  Synthetic polypeptide

SEQ ID NO: 7289 - DNA, 670 bp, Artificial Sequence; identical to SEQ ID NO: 6361
  Synthetic polypeptide

SEQ ID NO: 7290 - DNA, 665 bp, Artificial Sequence; identical to SEQ ID NO: 6374
  Synthetic polypeptide

SEQ ID NO: 7291 - DNA, 518 bp, Artificial Sequence; identical to SEQ ID NO: 6375
  Synthetic polypeptide

SEQ ID NO: 7292 - DNA, 80 bp, Artificial Sequence; identical to SEQ ID NO: 6364
  Synthetic polypeptide

SEQ ID NO: 7293 - DNA, 217 bp, Artificial Sequence; identical to SEQ ID NO: 6365
  Synthetic polypeptide

SEQ ID NO: 7294 - DNA, 2319 bp, Artificial Sequence; identical to SEQ ID NO: 6366
  Synthetic polypeptide

SEQ ID NO: 7295 - DNA, 382 bp, Artificial Sequence; identical to SEQ ID NO: 434
  Synthetic polypeptide

SEQ ID NO: 7296 - DNA, 486 bp, Artificial Sequence
  Synthetic polypeptide
ttgctgctctaagtgtcgcaaaccaggacagcagaattatctgggtggttgttggacgtccagtgtctcatgctggcctaaggatcggaatcggcattttaactacttcccggaggagcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccctgctgtcacttacatctataactgggcctacggctttgggtgggcagccacgattatcctgattggctgtgccttcttcttctgctgcctccccaactacgaagatgaccttctgggcaatgccaagcccaggtacttctacacatctgcctaa

SEQ ID NO: 7297 - DNA, 369 bp, Artificial Sequence
  Synthetic polypeptide
ctggctgggtgttcttcatcaagacaatcatgctgcgtaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataa

SEQ ID NO: 7298 - DNA, 337 bp, Artificial Sequence; identical to SEQ ID NO: 6393
  Synthetic polypeptide

SEQ ID NO: 7299 - DNA, 369 bp, Artificial Sequence; identical to SEQ ID NO: 6492
  Synthetic polypeptide

SEQ ID NO: 7300 - DNA, 1452 bp, Artificial Sequence
  Synthetic polypeptide
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactga

SEQ ID NO: 7301 - DNA, 1149 bp, Artificial Sequence
  Synthetic polypeptide
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtttcttcgtttgagtcagtcgccttga

SEQ ID NO: 7302 - DNA, 1416 bp, Artificial Sequence
  Synthetic polypeptide
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagtcgttccccatcaggaagtcctcgcagaagtgcaagtcctgaaagaatggactga

SEQ ID NO: 7303 - DNA, 1443 bp, Artificial Sequence
  Synthetic polypeptide
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgagatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactga

SEQ ID NO: 7304 - DNA, 1134 bp, Artificial Sequence
  Synthetic polypeptide
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggaggtgaggagcgtcgctgcccggccgccccgtctgagaagtgaggagcccctccgcccggcagccgccccgtctgggaagtgaggagcgtctccgcccggcagccaccccgtccgggaaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtatttattttaa

SEQ ID NO: 7305 - DNA, 540 bp, Artificial Sequence; identical to SEQ ID NO: 6513
  Synthetic polypeptide

SEQ ID NO: 7306 - DNA, 651 bp, Artificial Sequence; identical to SEQ ID NO: 6514
  Synthetic polypeptide

SEQ ID NO: 7307 - DNA, 569 bp, Artificial Sequence; identical to SEQ ID NO: 6515
  Synthetic polypeptide

SEQ ID NO: 7308 - DNA, 152 bp, Artificial Sequence; identical to SEQ ID NO: 6516
  Synthetic polypeptide

SEQ ID NO: 7309 - DNA, 252 bp, Artificial Sequence
  Synthetic polypeptide
ggccaggcacggtggctcacgcctgtaatcccagcactttgggaggccgagacgggcggatcacgaggtcaagagatggagaccatcccggctaacacgttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactga

SEQ ID NO: 7310 - DNA, 1883 bp, Artificial Sequence; identical to SEQ ID NO: 6345
  Synthetic polypeptide

SEQ ID NO: 7311 - DNA, 285 bp, Artificial Sequence; identical to SEQ ID NO: 6477
  Synthetic polypeptide

SEQ ID NO: 7312 - DNA, 414 bp, Artificial Sequence; identical to SEQ ID NO: 6481
  Synthetic polypeptide

SEQ ID NO: 7313 - DNA, 871 bp, Artificial Sequence; identical to SEQ ID NO: 437
  Synthetic polypeptide

SEQ ID NO: 7314 - DNA, 421 bp, Artificial Sequence; identical to SEQ ID NO: 441
  Synthetic polypeptide

SEQ ID NO: 7315 - DNA, 638 bp, Artificial Sequence; identical to SEQ ID NO: 442
  Synthetic polypeptide

SEQ ID NO: 7316 - DNA, 337 bp, Artificial Sequence; identical to SEQ ID NO: 443
  Synthetic polypeptide

SEQ ID NO: 7317 - DNA, 2448 bp, Artificial Sequence; identical to SEQ ID NO: 6618
  Synthetic polypeptide

SEQ ID NO: 7318 - DNA, 1543 bp, Artificial Sequence; identical to SEQ ID NO: 6619
  Synthetic polypeptide

SEQ ID NO: 7319 - DNA, 1468 bp, Artificial Sequence; identical to SEQ ID NO: 6620
  Synthetic polypeptide

SEQ ID NO: 7320 - DNA, 2672 bp, Artificial Sequence; identical to SEQ ID NO: 6621
  Synthetic polypeptide

SEQ ID NO: 7321 - DNA, 1767 bp, Artificial Sequence; identical to SEQ ID NO: 6622
  Synthetic polypeptide

SEQ ID NO: 7322 - DNA, 1692 bp, Artificial Sequence; identical to SEQ ID NO: 6623
  Synthetic polypeptide

SEQ ID NO: 7323 - DNA, 483 bp, Artificial Sequence
  Synthetic polypeptide
tagggaagtacctttaaattatatgcctcagtttcctcatctgtaaaattgggataatgagattttctacattttaggttgttgtggggattaagtgaaatacaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaa

SEQ ID NO: 7324 - DNA, 3021 bp, Artificial Sequence; identical to SEQ ID NO: 449
  Synthetic polypeptide

SEQ ID NO: 7325 - DNA, 3075 bp, Artificial Sequence; identical to SEQ ID NO: 450
  Synthetic polypeptide

SEQ ID NO: 7326 - DNA, 1143 bp, Artificial Sequence; identical to SEQ ID NO: 451
  Synthetic polypeptide

SEQ ID NO: 7327 - DNA, 769 bp, Artificial Sequence; identical to SEQ ID NO: 6486
  Synthetic polypeptide

SEQ ID NO: 7328 - DNA, 365 bp, Artificial Sequence; identical to SEQ ID NO: 6504
  Synthetic polypeptide

SEQ ID NO: 7329 - DNA, 509 bp, Artificial Sequence; identical to SEQ ID NO: 6505
  Synthetic polypeptide

SEQ ID NO: 7330 - DNA, 483 bp, Artificial Sequence
  Synthetic polypeptide
tagggaagtacctttaaattatatgcctcagtttcctcatctgtaaaattgggataatgagattttctacattttaggttgttgtggggattaagtgaaatacaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaa

SEQ ID NO: 7331 - DNA, 243 bp, Artificial Sequence; identical to SEQ ID NO: 6494
  Synthetic polypeptide

SEQ ID NO: 7332 - DNA, 1133 bp, Artificial Sequence
  Synthetic polypeptide
cacctggcctcctgctctctgtccttagatgtctgcggaaacatccctcgtcagaagcgcttgctcagttgtacacatgagcccgagggtcctcagcttttctttccataggttccagaggccgtagtttctttgtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctga

SEQ ID NO: 7333 - DNA, 1172 bp, Artificial Sequence
  Synthetic polypeptide
cacctggcctcctgctctctgtccttagatgtctgcggaaacatccctcgtcagaagcgcttgctcagttgtacacatgagcccgagggtcctcagcttttctttccataggttccagaggccgtagtttctttgtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagccgatcgggtcaggcaagtccatcccgtcctgagagccccaggccccccttcgacctctaa

SEQ ID NO: 7334 - DNA, 488 bp, Artificial Sequence; identical to SEQ ID NO: 6517
  Synthetic polypeptide

SEQ ID NO: 7335 - DNA, 299 bp, Artificial Sequence; identical to SEQ ID NO: 485
  Synthetic polypeptide

SEQ ID NO: 7336 - DNA, 545 bp, Artificial Sequence
  Synthetic polypeptide
gtgcttctctaccctggctgcatgttagaaatatcttgggagcttctaaatagtgttgaagttctagctccacttcagactcattaaatcagagctccttgggggtaggatccaggaaggaggagacagttactgtctatcccgcagacgtggtgctctttgaagggatcctggccttctactcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggccctccaaacggcagaccaatggctgtctcaacggctacaccccttcacgcaagaggcaggcatcggagtccagcagcaggccgcattga

SEQ ID NO: 7337 - DNA, 543 bp, Artificial Sequence; identical to SEQ ID NO: 6496
  Synthetic polypeptide

SEQ ID NO: 7338 - DNA, 378 bp, Artificial Sequence; identical to SEQ ID NO: 6497
  Synthetic polypeptide

SEQ ID NO: 7339 - DNA, 267 bp, Artificial Sequence; identical to SEQ ID NO: 6498
  Synthetic polypeptide

SEQ ID NO: 7340 - DNA, 416 bp, Artificial Sequence; identical to SEQ ID NO: 6499
  Synthetic polypeptide

SEQ ID NO: 7341 - DNA, 162 bp, Artificial Sequence; identical to SEQ ID NO: 6500
  Synthetic polypeptide

SEQ ID NO: 7342 - DNA, 2471 bp, Artificial Sequence; identical to SEQ ID NO: 576
  Synthetic polypeptide

SEQ ID NO: 7343 - DNA, 289 bp, Artificial Sequence
  Synthetic polypeptide
ataccttaaagcatccattccatgtaataaattaacttttcttctatttatctagaatgatgatatcaagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtag

SEQ ID NO: 7344 - DNA, 246 bp, Artificial Sequence
  Synthetic polypeptide
ataccttaaagcatccattccatgtaataaattaacttttcttctatttatctagaatgatgatatcaagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttt

SEQ ID NO: 7345 - DNA, 149 bp, Artificial Sequence
  Synthetic polypeptide
ataccttaaagcatccattccatgtaataaattaacttttcttctatttatctagaatgatgatatcaagattaaatctcttgatgaacagtgtgtggttggcaaaatttccaagcactggactggaattttgagagaggcatttacag

SEQ ID NO: 7346 - DNA, 89 bp, Artificial Sequence
  Synthetic polypeptide
ataccttaaagcatccattccatgtaataaattaacttttcttctatttatctagaatgatgatatcaagattaaatctcttgatgaac

SEQ ID NO: 7347 - DNA, 80 bp, Artificial Sequence
  Synthetic polypeptide
ataccttaaagcatccattccatgtaataaattaacttttcttctatttatctagaatgatgatatcaagattaaatctc

SEQ ID NO: 7348 - DNA, 2588 bp, Artificial Sequence; identical to SEQ ID NO: 6741
  Synthetic polypeptide

SEQ ID NO: 7349 - DNA, 1964 bp, Artificial Sequence; identical to SEQ ID NO: 6742
  Synthetic polypeptide

SEQ ID NO: 7350 - DNA, 2535 bp, Artificial Sequence; identical to SEQ ID NO: 6677
  Synthetic polypeptide

SEQ ID NO: 7351 - DNA, 2181 bp, Artificial Sequence; identical to SEQ ID NO: 6678
  Synthetic polypeptide

SEQ ID NO: 7352 - DNA, 1119 bp, Artificial Sequence; identical to SEQ ID NO: 6679
  Synthetic polypeptide

SEQ ID NO: 7353 - DNA, 1731 bp, Artificial Sequence; identical to SEQ ID NO: 6691
  Synthetic polypeptide

SEQ ID NO: 7354 - DNA, 2019 bp, Artificial Sequence; identical to SEQ ID NO: 6692
  Synthetic polypeptide

SEQ ID NO: 7355 - DNA, 2043 bp, Artificial Sequence; identical to SEQ ID NO: 6693
  Synthetic polypeptide

SEQ ID NO: 7356 - DNA, 554 bp, Artificial Sequence; identical to SEQ ID NO: 6694
  Synthetic polypeptide

SEQ ID NO: 7357 - DNA, 2537 bp, Artificial Sequence
  Synthetic polypeptide
aagttaaacatggaatagctatgtgactcagcaattccaaggtaagatgtaaaagaattgaaaagaagcattcaaacaaatacttctacacaaatgttcacagcagcagcagcagcactatttgtaataaccaaaaggtagaaacaagccaagtgttcatcaactgatgagtaggtaaacaaaatgtggtctatccatacaatggaatgttattgtatgaagtgctgatacatgctgtgacatggatcagccttgaaagtatgatgctaaatgaaagacaccagacacgaaagtcacgtgttgtatgatgccatttctatggaatgtccagcataggcaagtccacagatacagagtaaactggtggttttcaaggcctggagagagacggagtggctgcttaatagaccttcaacaagcttgtgggaaagtttagccagtccatctttcacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagtgtcctggaggcagcggtttctcttgggggtgaagacttgaccccattctatggtctgctgtctggtggccgggaaggaaaattctacagggagctagaagactacttctactattctcagctccgcagtcaaggcatcgacacaatggagaccagaaaggtgtcagaacacatttgcctgtcagagcttccttttgtcatgagagcaattggcttttacccatctgaagagaagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 7358 - DNA, 1913 bp, Artificial Sequence
  Synthetic polypeptide
aagttaaacatggaatagctatgtgactcagcaattccaaggtaagatgtaaaagaattgaaaagaagcattcaaacaaatacttctacacaaatgttcacagcagcagcagcagcactatttgtaataaccaaaaggtagaaacaagccaagtgttcatcaactgatgagtaggtaaacaaaatgtggtctatccatacaatggaatgttattgtatgaagtgctgatacatgctgtgacatggatcagccttgaaagtatgatgctaaatgaaagacaccagacacgaaagtcacgtgttgtatgatgccatttctatggaatgtccagcataggcaagtccacagatacagagtaaactggtggttttcaaggcctggagagagacggagtggctgcttaatagaccttcaacaagcttgtgggaaagtttagccagtccatctttcacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagccatcctgggagccaggcaccaatattatccccatcagacacatcaagaagctaa

SEQ ID NO: 7359 - DNA, 1022 bp, Artificial Sequence; identical to SEQ ID NO: 590
  Synthetic polypeptide

SEQ ID NO: 7360 - DNA, 347 bp, Artificial Sequence; identical to SEQ ID NO: 591
  Synthetic polypeptide

SEQ ID NO: 7361 - DNA, 1109 bp, Artificial Sequence; identical to SEQ ID NO: 592
  Synthetic polypeptide

SEQ ID NO: 7362 - DNA, 85 bp, Artificial Sequence; identical to SEQ ID NO: 601
  Synthetic polypeptide

SEQ ID NO: 7363 - DNA, 269 bp, Artificial Sequence; identical to SEQ ID NO: 600
  Synthetic polypeptide

SEQ ID NO: 7364 - DNA, 365 bp, Artificial Sequence
  Synthetic polypeptide
ctggctgggtgttcttcatcaagacaatcatgctgcgagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataa

SEQ ID NO: 7365 - DNA, 1854 bp, Artificial Sequence; identical to SEQ ID NO: 6613
  Synthetic polypeptide

SEQ ID NO: 7366 - DNA, 423 bp, Artificial Sequence; identical to SEQ ID NO: 6550
  Synthetic polypeptide

SEQ ID NO: 7367 - DNA, 1636 bp, Artificial Sequence; identical to SEQ ID NO: 531
  Synthetic polypeptide

SEQ ID NO: 7368 - DNA, 1328 bp, Artificial Sequence; identical to SEQ ID NO: 532
  Synthetic polypeptide

SEQ ID NO: 7369 - DNA, 2053 bp, Artificial Sequence
  Synthetic polypeptide
ggctgggcgcggtggctcacacctgcaatcccagcactttgggacgccgaggcgggtggatcacctaaggtcgagagttcaagaccaggctgaccattatggagaaaccccgtctctactaaaaatacagaaaattagctggataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccagattggtgctgaagacatggacggcttccaggcagacacggaggaggaggaagaggaggagggcgactgtatgatcgtggatgtcccggatgctgcggaggtccaagccccgtgtggagccgcttccggagctgggggtggtgtgggggtggacaccggcaaggccaccctgacctcgagcccactgggtgcatcctga

SEQ ID NO: 7370 - DNA, 902 bp, Artificial Sequence
  Synthetic polypeptide
tctgtctaccctcagccactcagaatctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctga

SEQ ID NO: 7371 - DNA, 427 bp, Artificial Sequence; identical to SEQ ID NO: 573
  Synthetic polypeptide

SEQ ID NO: 7372 - DNA, 445 bp, Artificial Sequence; identical to SEQ ID NO: 744
  Synthetic polypeptide

SEQ ID NO: 7373 - DNA, 59 bp, Artificial Sequence; identical to SEQ ID NO: 742
  Synthetic polypeptide

SEQ ID NO: 7374 - DNA, 123 bp, Artificial Sequence; identical to SEQ ID NO: 743
  Synthetic polypeptide

SEQ ID NO: 7375 - DNA, 1058 bp, Artificial Sequence
  Synthetic polypeptide
ccctccccctccccctccccctctccctcaccctctccctctccccacggtctccctctgatgccaagccaaagctggactgtactgctgccatctcggctcactgcaacctccctgcctgattctcctgcctcagcctgcccagtgcctgtgattgcaggcgcgcgccgccacgcctgactggttttggtggagacggggtttcgctgtgttggccgggccggtctccagcccctaaccacgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcatctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccatctgagaagtgaggagcctctccgcccggcagccaccccatctgggaaggtctctcactttgtcacccaggctggagcacagcggcacaacctcgggtcactgcagccttgacttccctggctcaaacaatcctcccacctcagcctcccaagttgctggaactacaggtgcatgccacccacacccggctaattttcgtattttttgaagagacgggatctcgccatgttgcctag

SEQ ID NO: 7376 - DNA, 463 bp, Artificial Sequence; identical to SEQ ID NO: 524
  Synthetic polypeptide

SEQ ID NO: 7377 - DNA, 711 bp, Artificial Sequence
  Synthetic polypeptide
atagacatgaaaatgttcaacttcataagcaatgaaagaaatggaaatcaaaacagaagccatttttcaaatacatcaaattgaataggatgaaaataacactaatattctaggcagtaccaagaagcaagagagacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgtctgatcctgaaagaggacaaactacattgcctttcagacctgtgactcaagaagaagatgatgaccaaaggtga

SEQ ID NO: 7378 - DNA, 1759 bp, Artificial Sequence; identical to SEQ ID NO: 6644
  Synthetic polypeptide

SEQ ID NO: 7379 - DNA, 1443 bp, Artificial Sequence; identical to SEQ ID NO: 6760
  Synthetic polypeptide

SEQ ID NO: 7380 - DNA, 984 bp, Artificial Sequence; identical to SEQ ID NO: 6761
  Synthetic polypeptide

SEQ ID NO: 7381 - DNA, 1032 bp, Artificial Sequence; identical to SEQ ID NO: 6762
  Synthetic polypeptide

SEQ ID NO: 7382 - DNA, 225 bp, Artificial Sequence; identical to SEQ ID NO: 7100
  Synthetic polypeptide

SEQ ID NO: 7383 - DNA, 1392 bp, Artificial Sequence; identical to SEQ ID NO: 6782
  Synthetic polypeptide

SEQ ID NO: 7384 - DNA, 933 bp, Artificial Sequence; identical to SEQ ID NO: 6783
  Synthetic polypeptide

SEQ ID NO: 7385 - DNA, 981 bp, Artificial Sequence; identical to SEQ ID NO: 6784
  Synthetic polypeptide

SEQ ID NO: 7386 - DNA, 2297 bp, Artificial Sequence
  Synthetic polypeptide
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaagtgaggagcgtctccgcccggcagccaccccgtccgggagggaggtgggggggtcagccccccgcccggccagccgccccgtccgggagaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 7387 - DNA, 2447 bp, Artificial Sequence
  Synthetic polypeptide
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaagtgaggagcgtctccgcccggcagccaccccgtccgggagggaggtgggggggtcagccccccgcccggccagccgccccgtccgggagaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 7388 - DNA, 2312 bp, Artificial Sequence
  Synthetic polypeptide
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaagtgaggagcgtctccgcccggcagccaccccgtccgggagggaggtgggggggtcagccccccgcccggccagccgccccgtccgggagaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccagagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 7389 - DNA, 2375 bp, Artificial Sequence
  Synthetic polypeptide
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaagtgaggagcgtctccgcccggcagccaccccgtccgggagggaggtgggggggtcagccccccgcccggccagccgccccgtccgggagaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgaggagctgaagaggaaaggggttgaatttcccatggcagacttggacgctctgtctcccatacacacaccacagcggattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggacttttctgtcctcggcccagaagagaggtagaggtggggagtctgacctggagcccatagacagctggcttataacccaaggaatgatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 7390 - DNA, 2093 bp, Artificial Sequence
  Synthetic polypeptide
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaagtgaggagcgtctccgcccggcagccaccccgtccgggagggaggtgggggggtcagccccccgcccggccagccgccccgtccgggagaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 7391 - DNA, 2090 bp, Artificial Sequence
  Synthetic polypeptide
tctccctctccctctcccgtctccccacggtctccctctccctctgtttccacggtctccctctcatgccgagccgaagctggactgtactgctgccatctcggctcactgcaacctccctgcctgattctcctgcctcagcctgccgagtgcctgcgattgcaggcacccgctgccacgcctgactggttttcgtattttttttggtggagacggggtttcgctgtgttggcctggccggtctccagctcctaaccgcgagcgatccgccagcctcggcctcccgaggtgccgggattgcagacggagtctcgttcactcagtgctcagtggtgccccggctggagtgcagtggcatgatctcggctcgctacaacctccaactcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctccgtccggccgccatcccacctaggaagtgaggagcgcctcttcccggccgccatcccatctaggaagtgaagagcgtctctgcccggccgcccatcgtctgagatgtggggagcgcctctgccccgccgccccgtctgggatgtgaggagcgcctctgccaggccgtgaccccgtctgggaggtgaggagtgtctctgcccggccaccccgtctgagaagtgaggagaccctctgcctggcaaccgccccgtctgagaagtgaggagcccctctgcccagcagccgccccgtctgagaagtgaggagcctctccgcccggcagccaccccgtctgggaagtgaggagcgtctccgcccggcagccaccccgtccgggagggaggtgggggggtcagccccccgcccggccagccgccccgtccgggagaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacaattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggacttttctgtcctcggcccagaagagaggtagaggtggggagtctgacctggagcccatagacagctggcttataacccaaggaatgatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtga

SEQ ID NO: 7392 - DNA, 1232 bp, Artificial Sequence; identical to SEQ ID NO: 6566
  Synthetic polypeptide

SEQ ID NO: 7393 - DNA, 497 bp, Artificial Sequence; identical to SEQ ID NO: 6567
  Synthetic polypeptide

SEQ ID NO: 7394 - DNA, 575 bp, Artificial Sequence; identical to SEQ ID NO: 6568
  Synthetic polypeptide

SEQ ID NO: 7395 - DNA, 1901 bp, Artificial Sequence; identical to SEQ ID NO: 7113
  Synthetic polypeptide

SEQ ID NO: 7396 - DNA, 1739 bp, Artificial Sequence; identical to SEQ ID NO: 7114
  Synthetic polypeptide

SEQ ID NO: 7397 - DNA, 1859 bp, Artificial Sequence; identical to SEQ ID NO: 7115
  Synthetic polypeptide

SEQ ID NO: 7398 - DNA, 1616 bp, Artificial Sequence; identical to SEQ ID NO: 7116
  Synthetic polypeptide

SEQ ID NO: 7399 - DNA, 501 bp, Artificial Sequence; identical to SEQ ID NO: 7117
  Synthetic polypeptide

SEQ ID NO: 7400 - DNA, 369 bp, Artificial Sequence; identical to SEQ ID NO: 7118
  Synthetic polypeptide

SEQ ID NO: 7401 - DNA, 807 bp, Artificial Sequence
  Synthetic polypeptide
ggctggatgcagtggctcacgcctgtaatcccaacactttgggaggctgagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaa

SEQ ID NO: 7402 - DNA, 453 bp, Artificial Sequence
  Synthetic polypeptide
ggctggatgcagtggctcacgcctgtaatcccaacactttgggaggctgagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaaggtcctggggaactggggctga

SEQ ID NO: 7403 - DNA, 238 bp, Artificial Sequence; identical to SEQ ID NO: 6628
  Synthetic polypeptide

SEQ ID NO: 7404 - DNA, 164 bp, Artificial Sequence; identical to SEQ ID NO: 831
  Synthetic polypeptide

SEQ ID NO: 7405 - DNA, 193 bp, Artificial Sequence; identical to SEQ ID NO: 834
  Synthetic polypeptide

SEQ ID NO: 7406 - DNA, 1031 bp, Artificial Sequence
  Synthetic polypeptide
tgtctccccagatcatcttctcccattcttctcccactcctaccagatttatgccctccctgctccactggaactgccctggccaacctcaccagtgacctccatgtcgcccaatccaaggtcggtttttgaccttcatctggacctaacagtcgatcacctcctgctcctggaaatgcgcatgcaattcagctttcagaacaccactctcacattagctcccttcccatccaggtcctttgttggtttctcatctgctcaacctctggatgttgttcacaccagtgctctcctctaccagctaaactcacccgagtgatcttgtccggtctcatggctttaaatgccacctataggccatcatttcccaggtttatacctccagcctggactcttccctgaatccagactcataaattcatctaacttctcttggatgtctaatgcacttgtcaagatcagcacgagtccaataactctgttcttccctgcagacctgaccttctacccacatccgtgacagctcctttcttctagctgcccaggccccagcccaggccatcgagtcagtggaaaggaaaaagcaagagaaaaagcaagaacaagaggacaacttggccgagatcaccaacctcctgcgtggggacctgctctccgagaacccgcagcaggcagccagctccttcgggccccaccgcgtggtccctgaccgctggaagggcatgacccaggagcagctggagcagatccgcctagtccagaagcagcaaatccaggagaagctgaggctccaggaagaaaagcgccagcgagacctggactgggaccggcggaggattcagggggctcgcgccaccctgctgtttgagcggcagcagtggcggcggcagcgcgacctgcgcagagctctggacagcagcaacctcagcctggccaaggagcagcatttgcagaaaaaatatatgaatgaagtctatacaaatcaacccacgggagactatttcacacaatttaatacaggaagtcgataa

SEQ ID NO: 7407 - DNA, 1052 bp, Artificial Sequence; identical to SEQ ID NO: 447
  Synthetic polypeptide

SEQ ID NO: 7408 - DNA, 1118 bp, Artificial Sequence; identical to SEQ ID NO: 448
  Synthetic polypeptide

SEQ ID NO: 7409 - DNA, 5464 bp, Artificial Sequence
  Synthetic polypeptide
gacctcgggttctacctacagcgtcctgtccaccatgccctcagactcagaaagcagcagctccctcagcagtgtgggcactaccgggaaggcgccgtccccaccacccctcctcactgaccagcaagtgaatgagaaggtggagaacctctccattcagctgcggctgatgacccgggagagaaacgagctccgcaagcgcctggcctttgctacgcatggcacggcctttgacaagaggccctaccacaggctgaatcctgactatgagaggctgaagatccagtgcgtgcgagccatgtcggacctgcagagcctgcagaaccagcacaccaacgccttgaagaggtgtgaggaggtggccaaggagactgacttctaccacacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcaggtgttgaagcacaacgggtcatccgagattctcaacaaactgtatgacacggccatggacaagttggaggtggtcaagaaggactatgacgcccttcggaagaggtacagtgagaaagtcgccatccacaatgcagacctgagccgcctggagcagctgggggaggagaaccagcggttgctgaagcagacagagatgctgacccagcagagggacacggccatccagctgcagcaccagtgcgccctctccctgaggaggtttgaggcgatccaccatgagctgaacaaggccacggcgcagaacaaggacctgcagtgggagatggagctgctgcagtcagagctgaccgagctgagaaccacgcaggtgaagacagcaaaggagtcggagaaatacagggaggagcgggacgctgtgtacagcgagtacaagctcatcatgagtgagcgtgaccaggtcatctctgagctggacaagctgcagaccgaagtggagctggccgagtccaagctcaagagcagcacatctgagaagaaggcggccaatgaggagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcgcagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctag

SEQ ID NO: 7410 - DNA, 4444 bp, Artificial Sequence
  Synthetic polypeptide
gacctcgggttctacctacagcgtcctgtccaccatgccctcagactcagaaagcagcagctccctcagcagtgtgggcactaccgggaaggcgccgtccccaccacccctcctcactgaccagcaagtgaatgagaaggtggagaacctctccattcagctgcggctgatgacccgggagagaaacgagctccgcaagcgcctggcctttgctacgcatggcacggcctttgacaagaggccctaccacaggctgaatcctgactatgagaggctgaagatccagtgcgtgcgagccatgtcggacctgcagagcctgcagaaccagcacaccaacgccttgaagaggtgtgaggaggtggccaaggagactgacttctaccacacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcaggtgttgaagcacaacgggtcatccgagattctcaacaaactgtatgacacggccatggacaagttggaggtggtcaagaaggactatgacgcccttcggaagaggtacagtgagaaagtcgccatccacaatgcagacctgagccgcctggagcagctgggggaggagaaccagcggttgctgaagcagacagagatgctgacccagcagagggacacggccatccagctgcagcaccagtgcgccctctccctgaggaggtttgaggcgatccaccatgagctgaacaaggccacggcgcagaacaaggacctgcagtgggagatggagctgctgcagtcagagctgaccgagctgagaaccacgcaggtgaagacagcaaaggagtcggagaaatacagggaggagcgggacgctgtgtacagcgagtacaagctcatcatgagtgagcgtgaccaggtcatctctgagctggacaagctgcagaccgaagtggagctggccgagtccaagctcaagagcagcacatctgagaagaaggcggccaatgaggagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcgcagctgccaggactccctgaccctgtccctcctgaaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctag

SEQ ID NO: 7411 - DNA, 574 bp, Artificial Sequence
  Synthetic polypeptide
gacctcgggttctacctacagcgtcctgtccaccatgccctcagactcagaaagcagcagctccctcagcagtgtgggcactaccgggaaggcgccgtccccaccacccctcctcactgaccagcaagtgaatgagaaggtggagaacctctccattcagctgcggctgatgacccgggagagaaacgagctccgcaagcgcctggcctttgctacgcatggcacggcctttgacaagaggccctaccacaggctgaatcctgactatgagaggctgaagatccagtgcgtgcgagccatgtcggacctgcagagcctgcagaaccagcacaccaacgccttgaagaggtgtgaggaggtggccaaggagactgacttctaccacacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcagagctga

SEQ ID NO: 7412 - DNA, 677 bp, Artificial Sequence; identical to SEQ ID NO: 747
  Synthetic polypeptide

SEQ ID NO: 7413 - DNA, 674 bp, Artificial Sequence; identical to SEQ ID NO: 748
  Synthetic polypeptide

SEQ ID NO: 7414 - DNA, 1490 bp, Artificial Sequence
  Synthetic polypeptide
ggcctgggaggggcccggccggcggggctgagcctgtgcgtcctggggtgaggcctgggaggggcccggccggcggggctgagcctgtgcgtcctggggtgaggcctgggaggggcccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtga

SEQ ID NO: 7415 - DNA, 1031 bp, Artificial Sequence
  Synthetic polypeptide
ggcctgggaggggcccggccggcggggctgagcctgtgcgtcctggggtgaggcctgggaggggcccggccggcggggctgagcctgtgcgtcctggggtgaggcctgggaggggcccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggccgctga

SEQ ID NO: 7416 - DNA, 1079 bp, Artificial Sequence
  Synthetic polypeptide
ggcctgggaggggcccggccggcggggctgagcctgtgcgtcctggggtgaggcctgggaggggcccggccggcggggctgagcctgtgcgtcctggggtgaggcctgggaggggcccggcggggctgagcctgtgcgtcctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgagtgcgcgcgcaggatgaagaagtgcatcaggtgccaggtggtcgtcagcaagaaactgcgcccagacggctctga

SEQ ID NO: 7417 - DNA, 829 bp, Artificial Sequence; identical to SEQ ID NO: 624
  Synthetic polypeptide

SEQ ID NO: 7418 - DNA, 2120 bp, Artificial Sequence; identical to SEQ ID NO: 6752
  Synthetic polypeptide

SEQ ID NO: 7419 - DNA, 1257 bp, Artificial Sequence; identical to SEQ ID NO: 625
  Synthetic polypeptide

SEQ ID NO: 7420 - DNA, 1215 bp, Artificial Sequence; identical to SEQ ID NO: 626
  Synthetic polypeptide

SEQ ID NO: 7421 - DNA, 507 bp, Artificial Sequence; identical to SEQ ID NO: 628
  Synthetic polypeptide

SEQ ID NO: 7422 - DNA, 313 bp, Artificial Sequence; identical to SEQ ID NO: 629
  Synthetic polypeptide

SEQ ID NO: 7423 - DNA, 291 bp, Artificial Sequence; identical to SEQ ID NO: 630
  Synthetic polypeptide

SEQ ID NO: 7424 - DNA, 842 bp, Artificial Sequence; identical to SEQ ID NO: 6534
  Synthetic polypeptide

SEQ ID NO: 7425 - DNA, 943 bp, Artificial Sequence; identical to SEQ ID NO: 6540
  Synthetic polypeptide

SEQ ID NO: 7426 - DNA, 2725 bp, Artificial Sequence; identical to SEQ ID NO: 6753
  Synthetic polypeptide

SEQ ID NO: 7427 - DNA, 2825 bp, Artificial Sequence; identical to SEQ ID NO: 6727
  Synthetic polypeptide

SEQ ID NO: 7428 - DNA, 1967 bp, Artificial Sequence
  Synthetic polypeptide
acggtctccctctcatgcggagccgaagctggactgtactgctgccatctcggctcactgcaacctccctgcctgattctcctgcctcagtctgccgaatgcctgtgattgcaggcacgcgccgccacgcctgactggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctctgcccggccgccatcccatctaggaagtgaggagcgcctcttcccagccgccatcacatctaggaagtgaagagcctctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaaagatggatttataaaagctattggtcctgctgatgttattcaaagacagttttctggagaaacttttgaagaaataattgactgctctgggaaatgtattctaccaggtttggtggatgcacacacacatccagtatgggctggtgaaagagttcacgaatttgcaatgaagttggcaggagccacctacatggaaattcaccaggccggaggagggatccactttaccgtggagcgcacgcgccaagccacagaggaggagctgttccgctccttgcagcaacggctccagtgcatgatgagggctggcaccacgctggtggagtgcaagagtggatatggcctcgacctggagaccgagctcaagatgctgcgcgtgattgagcgcgcccggcgggagctggacatcggcatctcggctacctactgcggggctcattcagtgcctaaaggaaaaactgctactgaagctgctgatgacatcatcaataaccacctcccaaagctgaaggaacttggcagaaatggggaaatacacgtggacaatatagacgtattttgtgagaaaggtgtctttgatctcgattccaccagaaggattcttcaacgtggaaaagatatagggttacagattaacttccatggggatgaactccacccgatgaaggctgctgagcttggggctgaactgggagcgcaggcaatcagccacctggaagaagtgagtgatgaaggcatcgttgccatggcaacggccaggtgctctgccatccttctgcccaccacagcctacatgctgagactgaaacaacctcgagccaggaagatgttagatgaaggagtaatagttgctctgggaagtgatttcaaccccaatgcatattgcttttcaatgccaatggtcatgcatctggcctgtgtaaacatgagaatgtccatgcctgaggccttggccgctgccaccatcaatgcagcttatgcactgggaaagtctcacacacacggatcgttggaagttggcaaacagggagatctcattatcatcaattcatcccgatgggagcatttgatttaccagttcggaggccatcatgaattaattgaatatgttatagctaaaggaaaactcatctataaaacatga

SEQ ID NO: 7429 - DNA, 1142 bp, Artificial Sequence
  Synthetic polypeptide
acggtctccctctcatgcggagccgaagctggactgtactgctgccatctcggctcactgcaacctccctgcctgattctcctgcctcagtctgccgaatgcctgtgattgcaggcacgcgccgccacgcctgactggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctctgcccggccgccatcccatctaggaagtgaggagcgcctcttcccagccgccatcacatctaggaagtgaagagcctctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaaagatggatttataaaagctattggtcctgctgatgttattcaaagacagttttctggagaaacttttgaagaaataattgactgctctgggaaatgtattctaccagttggcaggagccacctacatggaaattcaccaggccggaggagggatccactttaccgtggagcgcacgcgccaagccacagaggaggagctgttccgctccttgcagcaacggctccagtgcatgatgagggctggcaccacgctggtggagtgcaagagtggatatggcctcgacctggagaccgagctcaagatgctgcgcgtgattga

SEQ ID NO: 7430 - DNA, 3055 bp, Artificial Sequence; identical to SEQ ID NO: 709
  Synthetic polypeptide

SEQ ID NO: 7431 - DNA, 3058 bp, Artificial Sequence; identical to SEQ ID NO: 710
  Synthetic polypeptide

SEQ ID NO: 7432 - DNA, 670 bp, Artificial Sequence
  Synthetic polypeptide
gccagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatag

SEQ ID NO: 7433 - DNA, 718 bp, Artificial Sequence
  Synthetic polypeptide
gccagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatag

SEQ ID NO: 7434 - DNA, 682 bp, Artificial Sequence
  Synthetic polypeptide
gccagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatag

SEQ ID NO: 7435 - DNA, 730 bp, Artificial Sequence
  Synthetic polypeptide
gccagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatag

SEQ ID NO: 7436 - DNA, 1815 bp, Artificial Sequence; identical to SEQ ID NO: 581
  Synthetic polypeptide

SEQ ID NO: 7437 - DNA, 1516 bp, Artificial Sequence; identical to SEQ ID NO: 534
  Synthetic polypeptide

SEQ ID NO: 7438 - DNA, 591 bp, Artificial Sequence; identical to SEQ ID NO: 539
  Synthetic polypeptide

SEQ ID NO: 7439 - DNA, 482 bp, Artificial Sequence; identical to SEQ ID NO: 540
  Synthetic polypeptide

SEQ ID NO: 7440 - DNA, 444 bp, Artificial Sequence; identical to SEQ ID NO: 541
  Synthetic polypeptide

SEQ ID NO: 7441 - DNA, 334 bp, Artificial Sequence; identical to SEQ ID NO: 533
  Synthetic polypeptide

SEQ ID NO: 7442 - DNA, 38 bp, Artificial Sequence; identical to SEQ ID NO: 543
  Synthetic polypeptide

SEQ ID NO: 7443 - DNA, 245 bp, Artificial Sequence; identical to SEQ ID NO: 542
  Synthetic polypeptide

SEQ ID NO: 7444 - DNA, 103 bp, Artificial Sequence
  Synthetic polypeptide
ggctgggcatggtggctcgcgtctgtaatcccaacactatgggaggctaagatttctctatgaatcatcatcaagaactctgggagaacttttgaattcataa

SEQ ID NO: 7445 - DNA, 509 bp, Artificial Sequence
  Synthetic polypeptide
ggccgggcgcggtggctcacgcctgtaatcctagcactctgggaggccgaggcgggcggatcacgaggtcaggagatcaagaccatcctggctaacacggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtga

SEQ ID NO: 7446 - DNA, 1222 bp, Artificial Sequence; identical to SEQ ID NO: 6653
  Synthetic polypeptide

SEQ ID NO: 7447 - DNA, 451 bp, Artificial Sequence; identical to SEQ ID NO: 6654
  Synthetic polypeptide

SEQ ID NO: 7448 - DNA, 292 bp, Artificial Sequence; identical to SEQ ID NO: 6655
  Synthetic polypeptide

SEQ ID NO: 7449 - DNA, 504 bp, Artificial Sequence; identical to SEQ ID NO: 6656
  Synthetic polypeptide

SEQ ID NO: 7450 - DNA, 449 bp, Artificial Sequence; identical to SEQ ID NO: 6657
  Synthetic polypeptide

SEQ ID NO: 7451 - DNA, 454 bp, Artificial Sequence; identical to SEQ ID NO: 6658
  Synthetic polypeptide

SEQ ID NO: 7452 - DNA, 353 bp, Artificial Sequence; identical to SEQ ID NO: 7197
  Synthetic polypeptide

SEQ ID NO: 7453 - DNA, 121 bp, Artificial Sequence; identical to SEQ ID NO: 7198
  Synthetic polypeptide

SEQ ID NO: 7454 - DNA, 701 bp, Artificial Sequence; identical to SEQ ID NO: 658
  Synthetic polypeptide

SEQ ID NO: 7455 - DNA, 2419 bp, Artificial Sequence
  Synthetic polypeptide
tttggtgccgtgactcggatcgggggacctcccttgggagatcaatcccccatcctcctgctctttgctccatgagaaaaatccacctatgaccttaggtcctcagaccgaccagcccaagaaacatctcaccaatttcaaatccggtaagcggcctctttttactctcttctccaacctccctcactatccctcaacctctttctcctttcaatcttggcaccacacttcaatctctcccttctcttaatttcaattcctttcattttctggtagagacaaaggagacacgttttatccgtggacccaaaactccggcgctggccacagactgggaaggcagccttcccttggtgtttaatcattgcagggacacctctctgattattcactcacgtttcaagggtgtcagaccacgcagggacgcctgccttggtccttcacccttagcggcaagtcccgcttttctggggaaggggcaagtaccccaaccccttctctccttgtctctaccccttctctgctcttctgggggaggggcaagtacccctcaaccccttctccttcatccttagtggcaagtcccgctttcctggggcaggggcaagtacccctcaaccccttctccttcacccttagcggcaagtcccgctttcctagggggcaaaaaacccccaatcgcttatttctgcaccctgacctcttatctctgtgccctaatcccttatttccgtgccccaaccccttctctgcttttctggagggcaagaacccccccaccccttctccatgtctctactcttttctctgggcttgcctccttcactatgggcaagcttccaccttccattcctccttcttctcccttagcctgtgttctcaaaaacttaaaacctcttcaactcacacctgacctaaaatctaaatgacttattttcttctgcaatgccgcttgaccccaatacaaaccgacagtagttccaaatagccagaaaatggcactttgaatttttccatcctgcaagatctaaataattcttgttgtaaaataggcaaacggtctgaggtgcctgacgtccaggcattcttttacacatcagtcccttcctagtctctgtgcccagtgcaactcgtcccaaatcttccttctttccctcccgcctgtccccccagtcccaaccccaagcgtcgctgagtctttctaatcttccttttctacagacccgtctgacctctcccctcctcgccaggccgagctaggcctcaattcttcctcagcctctgctcctccaccctataatctttttatcgcctcccctcctcacacctggtcctgcttacagtttcgttccgtgactagccctcccccacctgcccagcaatttactcttaaaaaggtggctggagctaaaggcatagtcaaggttaatgctcctttttctttatcccaaatcagatagcatttaggctctttttcatcaaatataaaaatccagcccagttcatgacgtgtttggcagcaaccctgagacactttacagccctagaccctaaaaggtcaaaaggccatcttattctcaaaatacattttattagccaatctgctcccgacattaaataaaactccaaaaattagattccggccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcagccaggcgttcctccagaacctcctcccacaggagcttgctacacgtgccggaaatctggccactgggccaaggaatgcccgcagcccgggattcctcctaagccgcgtcccatctctctgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacagacgccgagcttccggtaactctcacagtgcaagatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatga

SEQ ID NO: 7456 - DNA, 407 bp, Artificial Sequence
  Synthetic polypeptide
ggccaggcgcagtggctcacacctgtaatcccagcactttgggacgccgaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactg

SEQ ID NO: 7457 - DNA, 481 bp, Artificial Sequence
  Synthetic polypeptide
ggccaggcgcagtggctcacacctgtaatcccagcactttgggacgccgaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtga

SEQ ID NO: 7458 - DNA, 236 bp, Artificial Sequence
  Synthetic polypeptide
ggccaggcgcagtggctcacacctgtaatcccagcactttgggacgccgaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtgg

SEQ ID NO: 7459 - DNA, 116 bp, Artificial Sequence
  Synthetic polypeptide
ggccaggcgcagtggctcacacctgtaatcccagcactttgggacgccgaggatgcctgccatattagatggagaggaggcagtttctaaatggcttgactttggtgaagtctcaa

SEQ ID NO: 7460 - DNA, 107 bp, Artificial Sequence
  Synthetic polypeptide
ggccaggcgcagtggctcacacctgtaatcccagcactttgggacgccgaggatgcctgccatattagatggagaggaggcagtttctaaatggcttgactttggtg

SEQ ID NO: 7461 - DNA, 1579 bp, Artificial Sequence
  Synthetic polypeptide
cctctctttccatggtctccctctcatgcggagccggactggactgtactgctgccatctcggctcactgcaacctccctgcctgattctcctgcctcagcctgccgagtgcctgcgattgcaggcacgcgccgccacgcctgactggttttggtggagacggggtttcgctgtgttggccgggccggtctccagcccctaaccgcgagtgatccgccagcctcggcctcccgaggtgccaggattgcagacggagtctcgttcactcagtgctcaatggtgcccaggctggagtgcagtggcgtgatctcggctcgctacaacctacacctcccagccgcctgccttggcctcctaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgcctcttcccagccgccatcccatctaggaagtgaggagcgcctcttcccagccgccatcacatctaggaagtgaggagcgtctctgcccggccgcccatcgtctgagatgtggggagtgcctctgccccgcggccccatctgggatgtgaggagcacctctgcccggccgcgaccccgtctgggaggtgaggagcgtctctgcccggccaccccgtctgagaagtgaggagaccctctgcctggcaaccaccccgtctgagaagtgaggagcccctccgcccggcagctgccccgtctgagaattggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttga

SEQ ID NO: 7462 - DNA, 1504 bp, Artificial Sequence
  Synthetic polypeptide
cctctctttccatggtctccctctcatgcggagccggactggactgtactgctgccatctcggctcactgcaacctccctgcctgattctcctgcctcagcctgccgagtgcctgcgattgcaggcacgcgccgccacgcctgactggttttggtggagacggggtttcgctgtgttggccgggccggtctccagcccctaaccgcgagtgatccgccagcctcggcctcccgaggtgccaggattgcagacggagtctcgttcactcagtgctcaatggtgcccaggctggagtgcagtggcgtgatctcggctcgctacaacctacacctcccagccgcctgccttggcctcctaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgcctcttcccagccgccatcccatctaggaagtgaggagcgcctcttcccagccgccatcacatctaggaagtgaggagcgtctctgcccggccgcccatcgtctgagatgtggggagtgcctctgccccgcggccccatctgggatgtgaggagcacctctgcccggccgcgaccccgtctgggaggtgaggagcgtctctgcccggccaccccgtctgagaagtgaggagaccctctgcctggcaaccaccccgtctgagaagtgaggagcccctccgcccggcagctgccccgtctgagaattggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggacagggccaagaggaccttgcctgcccagtccttggggagctcagatcctacgagactggtacccacaggaggaaatgggtactttagggaagcaggaagaggcgtcggaatcaggaaatcagaagatagcagcttggcaccacgtggcacacatcccctatacacacactggatctcattccagcaccgcggagacctgggcaatgtccgtgctgatgctgacggccgcgccatcttcagaatggaggatgagcagctga

SEQ ID NO: 7463 - DNA, 309 bp, Artificial Sequence; identical to SEQ ID NO: 6536
  Synthetic polypeptide

SEQ ID NO: 7464 - DNA, 1016 bp, Artificial Sequence; identical to SEQ ID NO: 6795
  Synthetic polypeptide

SEQ ID NO: 7465 - DNA, 1187 bp, Artificial Sequence; identical to SEQ ID NO: 6796
  Synthetic polypeptide

SEQ ID NO: 7466 - DNA, 965 bp, Artificial Sequence; identical to SEQ ID NO: 6797
  Synthetic polypeptide

SEQ ID NO: 7467 - DNA, 961 bp, Artificial Sequence; identical to SEQ ID NO: 6722
  Synthetic polypeptide

SEQ ID NO: 7468 - DNA, 2532 bp, Artificial Sequence
  Synthetic polypeptide
ctgtaagacctgcactttgggaggccaaggcgggtggctcacctgaggtcagtagttcaagaccagcctggccaacatggtgaaatcccatctctactaaaaatacaaaaaaatagctggatgtggtggtgggcgcctgtcatcccagctactcgggaggctgaggcaggagaatcgcatgaacccaggaggcagaggttgcagtgagccaagatcacaccattgcactccagcctgggcgaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaa

SEQ ID NO: 7469 - DNA, 2178 bp, Artificial Sequence
  Synthetic polypeptide
ctgtaagacctgcactttgggaggccaaggcgggtggctcacctgaggtcagtagttcaagaccagcctggccaacatggtgaaatcccatctctactaaaaatacaaaaaaatagctggatgtggtggtgggcgcctgtcatcccagctactcgggaggctgaggcaggagaatcgcatgaacccaggaggcagaggttgcagtgagccaagatcacaccattgcactccagcctgggcgaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaaggtcctggggaactggggctga

SEQ ID NO: 7470 - DNA, 1116 bp, Artificial Sequence
  Synthetic polypeptide
ctgtaagacctgcactttgggaggccaaggcgggtggctcacctgaggtcagtagttcaagaccagcctggccaacatggtgaaatcccatctctactaaaaatacaaaaaaatagctggatgtggtggtgggcgcctgtcatcccagctactcgggaggctgaggcaggagaatcgcatgaacccaggaggcagaggttgcagtgagccaagatcacaccattgcactccagcctgggcgaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggccgcgagagaagggagacacgcagccacaactgtcaccctcgacacccccacccgcgctctcccctgaaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatag

SEQ ID NO: 7471 - DNA, 999 bp, Artificial Sequence
  Synthetic polypeptide
caccccgcttagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaa

SEQ ID NO: 7472 - DNA, 112 bp, Artificial Sequence; identical to SEQ ID NO: 7120
  Synthetic polypeptide

SEQ ID NO: 7473 - DNA, 659 bp, Artificial Sequence
  Synthetic polypeptide
gccaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccaggagggctggcggactgtgggtgtgctggtctcccagcggagcaccctcctga

SEQ ID NO: 7474 - DNA, 1688 bp, Artificial Sequence
  Synthetic polypeptide
gccaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccagaccccaggccccggaccagtcagactccagccagaccctgccgtccatggttcatctcatccaggagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacagagccgggagctgctgcgctgtctggaggaggaagtccggcatttgccccacattctgttgggcacgctgctgcggcacaggccgggagagttgaagcccctgcccacggtcctcccatccatccaccagctgcaccccgcgtccccaaggggctccagcttcatagcgctgagccacaagctggggctgcctccagggaaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggtgggagcagccaggccaggccgccctctctgaggagctctgccagggcctgtccctgccccagtggcggctgcgctgggttcaggcccagggggccctgcagaagctgtgcagctga

SEQ ID NO: 7475 - DNA, 772 bp, Artificial Sequence
  Synthetic polypeptide
tgtgatactgtgaaatatatatttggtattctgccctcattttctggcgtacaactcctgaaatccttaggatctccaaaatgataagttctctttgtgctgtgaatgactgacagctggcagcccctaggcagcttcaggttgaggctgctcactggaatgacagatgcaggattcgagggttgggactttcagccccacccatacctctggggaagggaaaggggctgaagttaagttgatggctgatggtttaatcaatcttgcctacataatgaagcctctataaaaacccaaacaaggattggctggagagcttccaggtagctgaacacttggaggttcctggagggtgtggtgctccaaggaggacatggaagctccacgtcccttttccccatacctccctacaggcctcttcgatttgtgaactggtacacctctgtgtttccccgagttctgtgagctgcgctaattgaatcccaagaggaggctgtgggaaccccaactcgaagccgattggtcagaagttccggaggtcctgtgactggtatctgagaatgctgagatgtataaactgtcttcagagcaattccatgaggcagcctcaaagatggagagcacaataaagccccgcagggtggagcccgtctgctcagggttgcaggcccagattctccactgctaccgagatcgcccgcatgaggtgctgctgtgctcggacctggtcaaggcataccagcgctgcgtgagcgccgcccacaagggctga

SEQ ID NO: 7476 - DNA, 832 bp, Artificial Sequence
  Synthetic polypeptide
tgtgatactgtgaaatatatatttggtattctgccctcattttctggcgtacaactcctgaaatccttaggatctccaaaatgataagttctctttgtgctgtgaatgactgacagctggcagcccctaggcagcttcaggttgaggctgctcactggaatgacagatgcaggattcgagggttgggactttcagccccacccatacctctggggaagggaaaggggctgaagttaagttgatggctgatggtttaatcaatcttgcctacataatgaagcctctataaaaacccaaacaaggattggctggagagcttccaggtagctgaacacttggaggttcctggagggtgtggtgctccaaggaggacatggaagctccacgtcccttttccccatacctccctacaggcctcttcgatttgtgaactggtacacctctgtgtttccccgagttctgtgagctgcgctaattgaatcccaagaggaggctgtgggaaccccaactcgaagccgattggtcagaagttccggaggtcctgtgactggtatctgagaatgctgagatgtataaactgtcttcagagcaattccatgaggcagcctcaaagatggagagcacaataaagccccgcagggtggagcccgtctgctcagggttgcaggcccagattctccactgctaccgagatcgcccgcatgaggtgctgctgtgctcggacctggtcaaggcataccagcgctgcgtgagcgccgcccacaaggtaaggccttgcctgcctcccaggtttccaagggccttgggaggtaggcgaggtacctctatctag

SEQ ID NO: 7477 - DNA, 763 bp, Artificial Sequence
  Synthetic polypeptide
tgtgatactgtgaaatatatatttggtattctgccctcattttctggcgtacaactcctgaaatccttaggatctccaaaatgataagttctctttgtgctgtgaatgactgacagctggcagcccctaggcagcttcaggttgaggctgctcactggaatgacagatgcaggattcgagggttgggactttcagccccacccatacctctggggaagggaaaggggctgaagttaagttgatggctgatggtttaatcaatcttgcctacataatgaagcctctataaaaacccaaacaaggattggctggagagcttccaggtagctgaacacttggaggttcctggagggtgtggtgctccaaggaggacatggaagctccacgtcccttttccccatacctccctacaggcctcttcgatttgtgaactggtacacctctgtgtttccccgagttctgtgagctgcgctaattgaatcccaagaggaggctgtgggaaccccaactcgaagccgattggtcagaagttccggaggtcctgtgactggtatctgagaatgctgagatgtataaactgtcttcagagcaattccatgaggcagcctcaaagatggagagcacaataaaggtggagcccgtctgctcagggttgcaggcccagattctccactgctaccgagatcgcccgcatgaggtgctgctgtgctcggacctggtcaaggcataccagcgctgcgtgagcgccgcccacaagggctga

SEQ ID NO: 7478 - DNA, 557 bp, Artificial Sequence; identical to SEQ ID NO: 6591
  Synthetic polypeptide

SEQ ID NO: 7479 - DNA, 852 bp, Artificial Sequence; identical to SEQ ID NO: 753
  Synthetic polypeptide

SEQ ID NO: 7480 - DNA, 1691 bp, Artificial Sequence
  Synthetic polypeptide
tggaacagtggaaagaacttgtccttgtcctgggaatcaaaagatgtgaatcttgatttctactaaagatgaccctaggatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaa

SEQ ID NO: 7481 - DNA, 1727 bp, Artificial Sequence
  Synthetic polypeptide
tggaacagtggaaagaacttgtccttgtcctgggaatcaaaagatgtgaatcttgatttctactaaagatgaccctaggatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaactactctaaaatcttatgattcaaacaccccaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaa

SEQ ID NO: 7482 - DNA, 629 bp, Artificial Sequence
  Synthetic polypeptide
tggaacagtggaaagaacttgtccttgtcctgggaatcaaaagatgtgaatcttgatttctactaaagatgaccctaggatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggttggcttttacaaacccctaagcttcttctttacctttccttaaaatttcaaccttctcttttcttactctataattga

SEQ ID NO: 7483 - DNA, 1553 bp, Artificial Sequence
  Synthetic polypeptide
tggaacagtggaaagaacttgtccttgtcctgggaatcaaaagatgtgaatcttgatttctactaaagatgaccctaggatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaactactctaaaatcttatgattcaaacaccccaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaa

SEQ ID NO: 7484 - DNA, 868 bp, Artificial Sequence
  Synthetic polypeptide
gtttttaactgttgggctacatcacactctcctgaggatgcttaaaaccctacgcatattggagcctccgctaatccgatcagaatatctgcagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataa

SEQ ID NO: 7485 - DNA, 628 bp, Artificial Sequence
  Synthetic polypeptide
gtttttaactgttgggctacatcacactctcctgaggatgcttaaaaccctacgcatattggagcctccgctaatccgatcagaatatctgcagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgcttcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataa

SEQ ID NO: 7486 - DNA, 745 bp, Artificial Sequence
  Synthetic polypeptide
gtttttaactgttgggctacatcacactctcctgaggatgcttaaaaccctacgcatattggagcctccgctaatccgatcagaatatctgcagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaagtaa

SEQ ID NO: 7487 - DNA, 943 bp, Artificial Sequence
  Synthetic polypeptide
gtttttaactgttgggctacatcacactctcctgaggatgcttaaaaccctacgcatattggagcctccgctaatccgatcagaatatctgcagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagagtggccgtgccattttacattcccaccagcaatgtatgagagatccagtgtctccgaatcttcgccagcatttgtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataa

SEQ ID NO: 7488 - DNA, 1582 bp, Artificial Sequence
  Synthetic polypeptide
tctccctctccctccccgtttccctctccctccccgtctctgtctcccactttccacggtctccctctgatgccgagcccaaggtggactgtactgccgccatctcggctcactgcagcctccctgcctgattctcctgcctcagcctgcccagtgcctgggattgcaggcgcgtgccgccacgcctgactggtttttgtattttttggtggagaccgagttttgccgtgttggccgggctggtctccagctcctgaccgcgagtgatctgcccgcctcggcctcctgaggtgccgggattgcaggcggagtctcgctcactcagtgctcaatgttgcccaggctggagtgcagtggcgtgatctcggctagctacaacctccacctcccagccgcctgccttggcctcccaaagcgccgagattgcagcctctgcccggccgccaccccgtctgggaagtgaggagcgtctctgcctggccgcccatcgtctgggatgtgaggagcccctctgcccggccgcccagtctgggaagtgaggatcgcctcttcccggccgccatcccgtctgggaagtgaggagcgtctctgcccggtcgcccgtcgtctgagatgtggggagcgcctctgccccgcggccctgtctgggatgtgaggagtgcctctgcccggctgcgaccccgtctgggaactgaggagtgtctctgccagaccgccaccccgtctgggagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttga

SEQ ID NO: 7489 - DNA, 1007 bp, Artificial Sequence
  Synthetic polypeptide
ccctccccctccccctccccctctccctcaccctctccctctccccacggtctccctctgatgccaagccaaagctggactgtactgctgccatctcggctcactgcaacctccctgcctgattctcctgcctcagcctgcccagtgcctgtgattgcaggcgcgcgccgccacgcctgactggttttggtggagacggggtttcgctgtgttggccgggccggtctccagcccctaaccacgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcatctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccatctgagaagtgaggagcctctccgcccggcagccaccccatctgggaaacaggatcttgctacattgcccaggctggcctcgaactcctggcttcaagtgatcttcccgcctcggcctcccagagtgctgggataacaggtgtgagccaccatacccaaccagctttattactgatttccctctaa

SEQ ID NO: 7490 - DNA, 304 bp, Artificial Sequence
  Synthetic polypeptide
actgcagagcacagtcatcaagagcatgagctctagagccaaatctcatctccccacttcacggctgggtgaacttcaggcctcagtctccacatttgtaaaatgatgagaagcatacctgctctaggaggttgtcaggagtcaactgacaacagtgagctgggacggagacaagctccagtgtgtgcagaagggtgagaaggaggggcgtggctggacccagtggatcgagggtgatgagctgcacctggagatgagagtggaaggtgtggtctgcaagcaagtattcaagaaggtgcagtga

SEQ ID NO: 7491 - DNA, 1931 bp, Artificial Sequence
  Synthetic polypeptide
ctctccctctccccctccccctccccctctccctctccccacggtctccctctccctctctttccagggtctccctctgatgcccagccgaagctggactgtactgctgccatctcggctcactgcaacctccccgcctgattctcctgcctcagcctgcagagtgcctgccattgcaggcacgcgccgccacgcctgactggttttcgtatttttttggtggagatggggtttcgctgtgttggccgggctagtctccagctcctaaccgcgagtgatccgccagcctcggcctccggaggtgccgggattgcagacggtgtctggttcaatcagtgctcaatggtgcccaggctggaatgcagtggcgtgatctcggctcgctacaacctccacctcccagccacctgccttggcctcccaaagtgccgagagtgcagcctctgcccggccgccaccccgtctgggaagtgaggagcgtctctgcctggccgcctatcgtctgggacgtgaggagcccctctgcgtggctgcccagtctggaaagtgaggagcgtctctgcccggtcgccatcccatctaggaagtgaggagcgcctcttcccggccgccatcccatctaggaagtgaggagcatctctgcctggccgcccttcttctgagatgtggggagcgcctttgccccaccgccctgtctgggatgtgaggagcgcctctgccaggccgcgaccccgtctgggaggtgaggagcgtctctgcccagccgccccgtctgagaagggaggagaccctccgcccggcaaccgccccgtctcagaagaaccagtagatcctctaaaggaagaagccttattggtaaggttgatggcacatcccacgtcactggaaaaggagttacagttgaaacagtcttttctgtggatgagttttctgcatctgtcctcactggaaaactgaccactgtcttccttccaattgtctacacaattgtgtttgtggtgggtttgccaagtaacggcatggccctgtgggtctttcttttccgaactaagaagaagcaccctgctgtgatttacatggccaatctggccttggctgacctcctctctgtcatctggttccccttgaagattgcctatcacatacatggcaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattggcatctccctggcaatatggctgctgattctgctggtcaccattcctttgtatgtcgtgaagcagaccatcttcattcctgccctgaacatcacgacctgtcatgatgttttgcctgagcagctcttggtgggagacatgttcaattacttcctctctctggccattggggtctttctgttcccagccttcctcacagcctctgcctatgtgctgatgatcagaatgctgcgatcttctgccatggatgaaaactcagagaagaaaaggaagagggccatcaaactcattgtcactgtcctggccatgtacctgatctgcttcactcctagtaaccttctgcttgtggtgcattattttctgattaagagccagggccagagccatgtctatgccctgtacattgtagccctctgcctctctacccttaacagctgcatcgacccctttgtctattactttgtttcacatgatttcagggatcatgcaaagaacgctctcctttgccgaagtgtccgcactgtaaagcagatgcaagtatccctcacctcaaagaaacactccaggaaatccagctcttactcttcaagttcaaccactgttaagacctcctattga

SEQ ID NO: 7492 - DNA, 233 bp, Artificial Sequence; identical to SEQ ID NO: 856
  Synthetic polypeptide

SEQ ID NO: 7493 - DNA, 2322 bp, Artificial Sequence
  Synthetic polypeptide
aagttaaacatggaatagctatgtgactcagcaattccaaggtaagatgtaaaagaattgaaaagaagcattcaaacaaatacttctacacaaatgttcacagcagcagcagcagcactatttgtaataaccaaaaggtagaaacaagccaagtgttcatcaactgatgagtaggtaaacaaaatgtggtctatccatacaatggaatgttattgtatgaagtgctgatacatgctgtgacatggatcagccttgaaagtatgatgctaaatgaaagacaccagacacgaaagtcacgtgttgtatgatgccatttctatggaatgtccagcataggcaagtccacagatacagagtaaactggtggttttcaaggcctggagagagacggagtggctgcttaatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagtgtcctggaggcagcggtttctcttgggggtgaagacttgaccccattctatggtctgctgtctggtggccgggaaggaaaattctacagggagctagaagactacttctactattctcagctccgcagtcaaggcatcgacacaatggagaccagaaaggtgtcagaacacatttgcctgtcagagcttccttttgtcatgagagcaattggcttttacccatctgaagagaagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 7494 - DNA, 1698 bp, Artificial Sequence
  Synthetic polypeptide
aagttaaacatggaatagctatgtgactcagcaattccaaggtaagatgtaaaagaattgaaaagaagcattcaaacaaatacttctacacaaatgttcacagcagcagcagcagcactatttgtaataaccaaaaggtagaaacaagccaagtgttcatcaactgatgagtaggtaaacaaaatgtggtctatccatacaatggaatgttattgtatgaagtgctgatacatgctgtgacatggatcagccttgaaagtatgatgctaaatgaaagacaccagacacgaaagtcacgtgttgtatgatgccatttctatggaatgtccagcataggcaagtccacagatacagagtaaactggtggttttcaaggcctggagagagacggagtggctgcttaatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagccatcctgggagccaggcaccaatattatccccatcagacacatcaagaagctaa

SEQ ID NO: 7495 - DNA, 588 bp, Artificial Sequence
  Synthetic polypeptide
ataatatatgcaaaatgactttataaactaaagctttggagttatgcctgagttccagtgatggttcttagctcttcatggttctgttcttagctattgactgcaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataa

SEQ ID NO: 7496 - DNA, 400 bp, Artificial Sequence; identical to SEQ ID NO: 749
  Synthetic polypeptide

SEQ ID NO: 7497 - DNA, 2301 bp, Artificial Sequence; identical to SEQ ID NO: 750
  Synthetic polypeptide

SEQ ID NO: 7498 - DNA, 2381 bp, Artificial Sequence; identical to SEQ ID NO: 751
  Synthetic polypeptide

SEQ ID NO: 7499 - DNA, 692 bp, Artificial Sequence; identical to SEQ ID NO: 752
  Synthetic polypeptide

SEQ ID NO: 7500 - DNA, 811 bp, Artificial Sequence
  Synthetic polypeptide
cagccgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcctag

SEQ ID NO: 7501 - DNA, 2171 bp, Artificial Sequence
  Synthetic polypeptide
ggctgggcgcggtggctcacacctgcaatcccagcactttgggacgccgaggcgggtggatcacctaaggtcgagagttcaagaccaggctgaccattatggagaaaccccgtctctactaaaaatacagaaaattagctgggtatggtgacgcttgcctgtaatcccagctacgccggaggctgaggcgggagaaccgcttgaacccaggaggcagaggttgcggtggcctgagatcgtgccattgcactccagcctggataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccagattggtgctgaagacatggacggcttccaggcagacacggaggaggaggaagaggaggagggcgactgtatgatcgtggatgtcccggatgctgcggaggtccaagccccgtgtggagccgcttccggagctgggggtggtgtgggggtggacaccggcaaggccaccctgacctcgagcccactgggtgcatcctga

SEQ ID NO: 7502 - DNA, 364 bp, Artificial Sequence
  Synthetic polypeptide
atctggaggacactaactggaagaaagcataggcatccttaattgttgagaggacagaactggtacctgtgggtagctactatgtgaatggagatgtcagcttggtatgagaatttcataatggtagaacaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattga

SEQ ID NO: 7503 - DNA, 713 bp, Artificial Sequence
  Synthetic polypeptide
tgtctccccagatcatcttctcccattcttctcccactcctaccagatttatgccctccctgctccactggaactgccctggccaacctcaccagtgacctccatgtcgcccaatccaagaggccctctacacagagacaaggctgcagtttgacgagacagccaagcacctccagaagctggaaagcaccaccagaaaggcagtttgtgcatctgtgaaagacttcaacaagagccaggccatcgagtcagtggaaaggaaaaagcaagagaaaaagcaagaacaagaggacaacttggccgagatcaccaacctcctgcgtggggacctgctctccgagaacccgcagcaggcagccagctccttcgggccccaccgcgtggtccctgaccgctggaagggcatgacccaggagcagctggagcagatccgcctagtccagaagcagcaaatccaggagaagctgaggctccaggaagaaaagcgccagcgagacctggactgggaccggcggaggattcagggggctcgcgccaccctgctgtttgagcggcagcagtggcggcggcagcgcgacctgcgcagagctctggacagcagcaacctcagcctggccaaggagcagcatttgcagaaaaaatatatgaatgaagtctatacaaatcaacccacgggagactatttcacacaatttaatacaggaagtcgataa

SEQ ID NO: 7504 - DNA, 331 bp, Artificial Sequence
  Synthetic polypeptide
tgtctcgcccagcgcacttctgagcccccagagggccagcccgcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaa

SEQ ID NO: 7505 - DNA, 171 bp, Artificial Sequence
  Synthetic polypeptide
gccggatgtggtggttcatgcctgtaatcccagctactcgggaggctgaggcaagagaatcgcttgaactcaggaggcagaggttgcagtgagctgagattgccccactgaactccagcctgcgcgataagagtggacattgaagtggacctaattcggttttccttttaa

SEQ ID NO: 7506 - DNA, 308 bp, Artificial Sequence
  Synthetic polypeptide
ggccgggcgcggtgcctcacgccttgtaatcccttcactttgggagatcaaggcggggggaatcacctgaggtcgggagttcgagaccagcctggccaacaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctga

SEQ ID NO: 7507 - DNA, 423 bp, Artificial Sequence
  Synthetic polypeptide
ggccgggcgcggtgcctcacgccttgtaatcccttcactttgggagatcaaggcggggggaatcacctgaggtcgggagttcgagaccagcctggccaacaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattga

SEQ ID NO: 7508 - DNA, 369 bp, Artificial Sequence
  Synthetic polypeptide
ggccgggcgcggtgcctcacgccttgtaatcccttcactttgggagatcaaggcggggggaatcacctgaggtcgggagttcgagaccagcctggccaacaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacgacatccccgattgaaagaaccagagaggctctga

SEQ ID NO: 7509 - DNA, 456 bp, Artificial Sequence
  Synthetic polypeptide
ggccgggcgcggtgcctcacgccttgtaatcccttcactttgggagatcaaggcggggggaatcacctgaggtcgggagttcgagaccagcctggccaacaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagaaatgatcggaaaccatttgtgggtttgtagaagcaggcatgcgtag

SEQ ID NO: 7510 - DNA, 375 bp, Artificial Sequence
  Synthetic polypeptide
tgtttgttcacggtgtgtgtctgtgttactattgctaactgtgtatatcgcatttcagtgagggcaggacaaggacccaggatcgtcttggtggcagtgttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtga

SEQ ID NO: 7511 - DNA, 119 bp, Artificial Sequence; identical to SEQ ID NO: 6582
  Synthetic polypeptide

SEQ ID NO: 7512 - DNA, 1340 bp, Artificial Sequence; identical to SEQ ID NO: 7107
  Synthetic polypeptide

SEQ ID NO: 7513 - DNA, 2066 bp, Artificial Sequence; identical to SEQ ID NO: 639
  Synthetic polypeptide

SEQ ID NO: 7514 - DNA, 476 bp, Artificial Sequence; identical to SEQ ID NO: 646
  Synthetic polypeptide

SEQ ID NO: 7515 - DNA, 488 bp, Artificial Sequence; identical to SEQ ID NO: 647
  Synthetic polypeptide

SEQ ID NO: 7516 - DNA, 916 bp, Artificial Sequence
  Synthetic polypeptide
acctggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataa

SEQ ID NO: 7517 - DNA, 157 bp, Artificial Sequence
  Synthetic polypeptide
acctggagacgaagtttccgtgcattatgaccccatgattgcgaagctggtcgtgtgggcagcagatcgccaggcggcattgacaaaactgaggtacagccttcgtcagtacaatatcaattctctccattttcgtctagcagtggaagaagactga

SEQ ID NO: 7518 - DNA, 424 bp, Artificial Sequence
  Synthetic polypeptide
acctggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaattga

SEQ ID NO: 7519 - DNA, 675 bp, Artificial Sequence
  Synthetic polypeptide
acctggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactca

SEQ ID NO: 7520 - DNA, 336 bp, Artificial Sequence
  Synthetic polypeptide
ttaaccctgcattgtagcacatgcctgtaatcccagcagctactcaggaggctgagacacgagaatcacttgaacctgggaagcagagtgagctgagatcacaccactccactccagcctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgcccc

SEQ ID NO: 7521 - DNA, 346 bp, Artificial Sequence
  Synthetic polypeptide
ttaaccctgcattgtagcacatgcctgtaatcccagcagctactcaggaggctgagacacgagaatcacttgaacctgggaagcagagtgagctgagatcacaccactccactccagcctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgccccagacccttga

SEQ ID NO: 7522 - DNA, 776 bp, Artificial Sequence
  Synthetic polypeptide
tgtagtggattgaatggtggttcacagaaagatctgtccacatcccgaagcccagaacctagaatgagactttatttgaaaataaagaactttgccggtgtaattagttagagatctagagatgagatcatcctggagtagggtaggtcctaaatccactgaccggtatccttctaaaagacagaagaggagacacagacacagaggagaagtccacgtggagacggaggcagagactggagtgatctgaccacggggtcagggactccccgagcccccagaagctgggaaaggcaggaagggttcctgccctagaagaccgtccagagagagcacgaccctgtccactcctgaatttcagacttctggtctccagaagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacgtctacaagcacgtgttctgggccacccgtctggcgaagaagcttctcggctggttgcttttcaagacccccgatgaaggagcgtggacttccatctacgcagcagtcaccccagagctggaaggagttggtggccattacctatacaacgagaaagagaccaagtccctccacgtcacctacaaccagaaactgcagcagcagctgtggtctaagagttgtgagatgactggggtccttgatgtgaccctgtga

SEQ ID NO: 7523 - DNA, 548 bp, Artificial Sequence
  Synthetic polypeptide
tgtagtggattgaatggtggttcacagaaagatctgtccacatcccgaagcccagaacctagaatgagactttatttgaaaataaagaactttgccggtgtaattagttagagatctagagatgagatcatcctggagtagggtaggtcctaaatccactgaccggtatccttctaaaagacagaagaggagacacagacacagaggagaagtccacgtggagacggaggcagagactggagtgatctgaccacggggtcagggactccccgagcccccagaagctgggaaaggcaggaagggttcctgccctagaagaccgtccagagagagcacgaccctgtccactcctgaatttcagacttctggtctccagaagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacgtctacaagcacgtgttctgggccacc

SEQ ID NO: 7524 - DNA, 2781 bp, Artificial Sequence
  Synthetic polypeptide
cctagatttaagatggtgcggctgagaccaccttcctggcagccagctgctgctgaagggaaaggcagaagtggggaagacttttttcaaaagatcatggaggaaacaaatacgcagattgcttggccatcaaaactgaagatcggagccaaatccaagaaagatccccatattaaggtttctggaaagaaagaagatgttaaagaagccaaggaaatgatcatgtctgtcttagacacaaaaagcaatcgagtcacactgaagatggatgtttcacatacagaacattcacatgtaatcggcaaaggtggcaacaatattaaaaaagtgatggaagaaaccggatgccatatccactttccagattccaacaggaataaccaagcagaaaaaagcaaccaggtatctatagcgggacaaccagcaggagtagaatctgcccgagttagaattcgggagctgcttcctttggtgctgatgtttgagctaccaattgctggaattcttcaaccggttcctgatcctaattccccctctattcagcatatatcacaaacgtacaatatttcagtatcatttaaacagcgttcccgaatgtatggtgctactgtcatagtacgagggtctcagaataacactagtgctgtgaaggaaggaactgccatgctgttagaacatcttgctgggagcttagcatcagctattcctgtgagcacacaactagatattgcagctcaacatcatctctttatgatgggtcgaaatgggagcaacatcaaacatatcatgcagagaacaggtgctcagatccactttcctgatcccagtaatccacaaaagaaatctaccgtctacctccagggcaccattgagtctgtctgtcttgcaaggcaatatctcatgggttgtcttcctcttgtgttgatgtttgatatgaaggaagaaattgaagtagatccacaattcattgcgcagttgatggaacagcttgatgtcttcatcagtattaaaccaaagcccaaacagccaagcaagtctgtgattgtgaaaagtgttgagcgaaatgccttaaatatgtatgaagcaaggaaatgtctcctcggacttgaaagcagtggggttaccatagcaaccagtccatccccagcatcctgccctgccggcctggcatgtcccagcctggatatcttagcttcagcaggccttggactcactggactaggtcttttgggacccaccaccttatctctgaacacttcaacaaccccaaactcactcttgaatgctcttaatagctcagtcagtcctttgcaaagtccaagttctggtacacccagccccacattatgggcacccccacttgctaatacttcaagtgccacaggtttttctgctataccacaccttatgattccatctactgcccaagccacattaactaatattttgttgtctggagtgcccacctatgggcacacagctccatctccccctcctggcttgactcctgttgatgtccatatcaacagtatgcagaccgaaggcaaaaaaatctctgctgctttaaatggacatgcacagtctccagatataaaatatggtgcaatatccacttcatcacttggagaaaaagtgctgagtgcaaatcacggggatccgtccatccagacaagtgggtctgagcagacatctcccaaatcaagccccactgaaggttgtaatgatgcttttgttgaagtaggcatgcctcgaagtccttcccattctgggaatgctggtgacttgaaacagatgatgtgtccctccaaggtttcctgtgccaaaaggcagacagtggaactattgcaaggcacgaaaaactcacacttacacagcactgacaggttgctctcagaccctgaactgagtgctaccgaaagccctttggctgacaagaaggctccagggagtgagcgcgctgcagagagggcagcagctgcccagcaaaactccgaaagggcccaccttgctccacggtcatcatatgtcaacatgcaggcatttgactatgaacagaagaagctattagccaccaaagctatgttaaagaaaccagtggtgacggaggtcagaacgcccacaaatacctggagtggcctgggtttttctaaatccatgccagctgaaactatcaaggagttgagaagggccaatcatgtgtcctataagcccacaatgacaaccacttatgagggctcatccatgtccctttcacggtccaacagtcgtgagcacttgggaggtggaagcgaatctgataactggagagaccgaaatggaattggacctggaagtcatagtgaatttgcagcttctattggcagccctaagcgtaaacaaaacaaatcaacggaacactatctcagcagtagcaattacatggactgcatttcctcgctgacaggaagcaatggctgtaacttaaatagctctttcaaaggttctgacctccctgagctcttcagcaaactgggcctgggcaaatacacagatgttttccagcaacaagagatcgatcttcagacattcctcactctcacagatcaggatctgaaggagctgggaataactacttttggtgccaggaggaaaatgctgcttgcaatttcagaactaaataaaaaccgaagaaagctttttgaatcgccaaatgcacgcacctctttcctggaaggtggagcgagtggaaggctaccccgtcagtatcactcagacattgctagtgtcagtggccgctggtag

SEQ ID NO: 7525 - DNA, 560 bp, Artificial Sequence; identical to SEQ ID NO: 6322
  Synthetic polypeptide

SEQ ID NO: 7526 - DNA, 340 bp, Artificial Sequence
  Synthetic polypeptide
ctagaattgcaatggtctcttcacagcctgccttgcctcccagatatcaggctcctgagggcagggcccatgcctgatttatgtcagtggcaagccctggagaacatcagtgaatgtttgttgagagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttag

SEQ ID NO: 7527 - DNA, 316 bp, Artificial Sequence
  Synthetic polypeptide
ctagaattgcaatggtctcttcacagcctgccttgcctcccagatatcaggctcctgagggcagggcccatgcctgatttatgtcagtggcaagccctggagaacatcagtgaatgtttgttgagagagcgtgtcatcctcaggaacaccccacaagcgggactccttcatctatagcacgtggctggaggacagtgtcagcaccactagtgggggcagctccccagacgccggcaagttgggggaccctgcgtgtcccgagatcaagatccagctggaagcatctgagcagcacatgccccagctgggctgttag

SEQ ID NO: 7528 - DNA, 1002 bp, Artificial Sequence
  Synthetic polypeptide
cagttgtctccctttatccgcagtttggctttctgcagtttcagttacctgcagtcaaccctagtctgaaaatattaaatagaaaattccagaaataaacaattcataaattttaaattatgcacctttctgagtagcatgatgaaatcctgggatattctacttcatccacgcaggatgtgagtcattcccttgtctgtctacctgctcgttagtcacttagcagcactctgggttagatcaactgtggtggtatctccgcgcttatgttcaggaacacagcctattggatccctaggctcaatatgtcctaatagttatggaagtgtgaaagatgtgtgcactgcaaaatttggctccaaacatttttttcatcttattcctaatgaagcaacaatctgcagcttgcttctctgcaacagaaatgacactgcctgggatgagctgaagctcacgtgtcagacggcactgcatgtcctgcagttaacactcaaggaaccatgggctttgttgggaggtggctgtactgaaactcatttggctgcatatatcagacacaagactcacaacgacccagaaagcattctcaaagatgatgaatgtactcaaacagaacttcaattaattgctgaagcattttgcagtgccctagaatctgttgttggctctttagaacatgatggaggtgaaattctcactgacatgaagtatggacacctttggtcagttcaggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgaccttggactgtttgactgcaaagcttagtggcctacaggtggctgtagagacagccaatttgattttggatctttcatatgttattgaagataaaaactaa

SEQ ID NO: 7529 - DNA, 665 bp, Artificial Sequence; identical to SEQ ID NO: 6374
  Synthetic polypeptide

SEQ ID NO: 7530 - DNA, 518 bp, Artificial Sequence; identical to SEQ ID NO: 6375
  Synthetic polypeptide

SEQ ID NO: 7531 - DNA, 401 bp, Artificial Sequence
  Synthetic polypeptide
tacatttcctagcactgcccctaaacaggtagaaacaaactacacctctgtagaaaggagcacaccgtgtatccagttcttggtttataaacactattcttcactaaagttccatggagaaattgctgattccaggtcaggggcagggaaactttgggtgatcatggattatcttttgacagaaaataaggaagtactcaaaaacgggtggacatgttgaaagaacacatgtcatcttggaaggattctcacagactacagttgggaaaatttgagcatcaaaatgaataacgtcaagaatggattataatacattgaataaaaaaggatatatgagtctatactgataaattttcttttaaattgggaaaatccatcctctcagtattggaaggaagtgg

SEQ ID NO: 7532 - DNA, 724 bp, Artificial Sequence
  Synthetic polypeptide
tacatttcctagcactgcccctaaacaggtagaaacaaactacacctctgtagaaaggagcacaccgtgtatccagttcttggtttataaacactattcttcactaaagttccatggagaaattgctgattccaggtcaggggcagggaaactttgggtgatcatggattatcttttgacagaaaataaggaagtactcaaaaacgggtggacatgttgaaagaacacatgtcatcttggaaggattctcacagactacagttgggaaaatttgagcatcaaaatgaataacgtcaagaatggattataatacattgaataaaaaaggatatatgagtctatactgataaattttcttttaaattgggaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatga

SEQ ID NO: 7533 - DNA, 632 bp, Artificial Sequence
  Synthetic polypeptide
tacatttcctagcactgcccctaaacaggtagaaacaaactacacctctgtagaaaggagcacaccgtgtatccagttcttggtttataaacactattcttcactaaagttccatggagaaattgctgattccaggtcaggggcagggaaactttgggtgatcatggattatcttttgacagaaaataaggaagtactcaaaaacgggtggacatgttgaaagaacacatgtcatcttggaaggattctcacagactacagttgggaaaatttgagcatcaaaatgaataacgtcaagaatggattataatacattgaataaaaaaggatatatgagtctatactgataaattttcttttaaattgggaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaa

SEQ ID NO: 7534 - DNA, 382 bp, Artificial Sequence; identical to SEQ ID NO: 434
  Synthetic polypeptide

SEQ ID NO: 7535 - DNA, 193 bp, Artificial Sequence
  Synthetic polypeptide
aagggcagccatctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtg

SEQ ID NO: 7536 - DNA, 1066 bp, Artificial Sequence
  Synthetic polypeptide
aagggcagccatctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcagcaggaatccaagcgctttgtgcagtggcagtcgtctatctga

SEQ ID NO: 7537 - DNA, 1063 bp, Artificial Sequence
  Synthetic polypeptide
aagggcagccatctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctga

SEQ ID NO: 7538 - DNA, 404 bp, Artificial Sequence
  Synthetic polypeptide
aagggcagccatctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccc

SEQ ID NO: 7539 - DNA, 925 bp, Artificial Sequence
  Synthetic polypeptide
aagggcagccatctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtga

SEQ ID NO: 7540 - DNA, 1093 bp, Artificial Sequence
  Synthetic polypeptide
aagggcagccatctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccaggaatccaagcgctttgtgcagtggcagtcgtctatctgagcccctcctcccggctggactggagcctggctcccctcttcgttccttccctggctgccggaggagaccccactaa

SEQ ID NO: 7541 - DNA, 1133 bp, Artificial Sequence; identical to SEQ ID NO: 7332
  Synthetic polypeptide

SEQ ID NO: 7542 - DNA, 1172 bp, Artificial Sequence; identical to SEQ ID NO: 7333
  Synthetic polypeptide

SEQ ID NO: 7543 - DNA, 80 bp, Artificial Sequence; identical to SEQ ID NO: 6364
  Synthetic polypeptide

SEQ ID NO: 7544 - DNA, 217 bp, Artificial Sequence; identical to SEQ ID NO: 6365
  Synthetic polypeptide

SEQ ID NO: 7545 - DNA, 432 bp, Artificial Sequence
  Synthetic polypeptide
aaaatagtgaccaagatctgcgcccagtgtgagatggagcacagtgctgacggcctcatggagcagatgtgctccagtgactttgtggtcaaaatgcgcatcaaggagatcaagatagagaatggggaccggaagctgattggagcccagaaaaagaagaagctgctcaagccgggccccctgaagcgcaaggacaccaagcggctggtgctgcacatgaagaatggcgcgggctgcccctgcccacagctggacagcctggcgggcagcttcctggtcatgggccgcaaagtggatggacagctgctgctcatggccgtctaccgctgggacaagaagaataaggagatgaagtttgcagtcaaattcatgttctcctacccctgctccctctactaccctttcttctacggggcggcagagccccactga

SEQ ID NO: 7546 - DNA, 784 bp, Artificial Sequence
  Synthetic polypeptide
tgtagtaactggctttcaagatagcccccagtgaaccctacctcctgatgtttgcactgtgtataatcctctcacacaacataccaagttgatatgtgtgaacaatagaataaggtcagtgtgatagtatgtcacttttgaggttgcgttatgaccgacactgcagcttctgtctcagttgctctgtcagtttgtctctggaagccagctgccatgtggtgaacaggccagtggagaggccaacatagtgaggaactgaggctgttgtcatcagtcatgtgagtgagcctagaagcagattctccagcccagttaagccttcagatgactgaagccccaaccaacatcttgattaaaaactcatgagaagccccgaatcataatcacccacctaagctgcttctaaattcctgaccaacggaaactttgagataagaattgtgtcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtag

SEQ ID NO: 7547 - DNA, 568 bp, Artificial Sequence; identical to SEQ ID NO: 6787
  Synthetic polypeptide

SEQ ID NO: 7548 - DNA, 181 bp, Artificial Sequence; identical to SEQ ID NO: 6788
  Synthetic polypeptide

SEQ ID NO: 7549 - DNA, 1643 bp, Artificial Sequence
  Synthetic polypeptide
ggccgggtgcagtggctcactcctgtaattccagcactttgggaggctgaggcggctggatcacttgagatcaagagttcgagaccaccctgaccaacatgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaa

SEQ ID NO: 7550 - DNA, 1457 bp, Artificial Sequence
  Synthetic polypeptide
ggccgggtgcagtggctcactcctgtaattccagcactttgggaggctgaggcggctggatcacttgagatcaagagttcgagaccaccctgaccaacatgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaa

SEQ ID NO: 7551 - DNA, 637 bp, Artificial Sequence
  Synthetic polypeptide
gctctagaggacacaactgggtttgaatgtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctga

SEQ ID NO: 7552 - DNA, 658 bp, Artificial Sequence
  Synthetic polypeptide
gctctagaggacacaactgggtttgaatgtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggggaagtcgcggccactgcctgtgtga

SEQ ID NO: 7553 - DNA, 607 bp, Artificial Sequence
  Synthetic polypeptide
gctctagaggacacaactgggtttgaatgtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatcc

SEQ ID NO: 7554 - DNA, 294 bp, Artificial Sequence
  Synthetic polypeptide
cagccttactttaaaaaataaattctgaaactgactgcttctcaccaacttccctggcaccattgtggctaagccactgtcatattttcctgattatctcaccagacccctggagatctccacccagcagccagacggacgctatttaacaccaaggatacttttgtggaactctatgggaacaatgcagcagccgagagccgaaagggccaggaacgcttcaaccgctggttcctgacgggcatgactgtggccggcgtggttctgctgggctcactcttcagtcggaaatga

SEQ ID NO: 7555 - DNA, 208 bp, Artificial Sequence
  Synthetic polypeptide
cagccttactttaaaaaataaattctgaaactgactgcttctcaccaacttccctggcaccattgtggctaagccactgtcatattttcctgattatctcaccagacccctggagatctccacccagcagccagacggacgctatttaacaccaaggatacttttgtggaactctatgggaacaatgcagcagccgagagccgaaagg

SEQ ID NO: 7556 - DNA, 1167 bp, Artificial Sequence
  Synthetic polypeptide
agagacagggtgatatattggagacagcatgtgatttgtatccaaattctgcactagactcctagctcatcccattccagcagggtaaaaccagtaatccatagcaggatcaacgtgtcagctcgctttagaaaaccgcttcaggagccgtgcactatcttcttgattgcaaatggagacctcataaacccagcttctcgcctccttatccccagaaaaaccttgaatcagtgggatcatgtactacaaatggtcacagaaaaaatcactctgaggagcggggctgttcacaggctttatactttagaaggaaaacttgttgagagtggagcagagttggagaatgggcagttttatgtggctgttggcagagataagtttaagaaactgccttacagtgagttactttttgacaagtcaacgatgagaaggccttttggtcagaaagcttcttcactacctcctattgtaggatccagaaagtctaaagggagtggaaatgatcgccactctaagtcaacagttggatccagtgacaactcatctcctcagcccctgaagaggaaagggaaaaaagaagacgtgaattcagaaaaactgacgaaattgaaacaaaatgtaaaattaaagaattcacaagaaaccattccaaatagtgatgaaggcattttcaaagctggagcagagaggtctgaaacacggggggcagcagaagtccaagaagatgaagatactcaggttgaggttccagtcgatcagaggccagcagaaatagtagacgaggaagaagatggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggctgatgtagaccctcaaagaccaccaaggccagaagtaaaaattaccagtccagaagaaaatgaaaacaaccaacaaaacaaggactatgctgccgtggcttag

SEQ ID NO: 7557 - DNA, 1052 bp, Artificial Sequence; identical to SEQ ID NO: 447
  Synthetic polypeptide

SEQ ID NO: 7558 - DNA, 1118 bp, Artificial Sequence; identical to SEQ ID NO: 448
  Synthetic polypeptide

SEQ ID NO: 7559 - DNA, 2614 bp, Artificial Sequence
  Synthetic polypeptide
ggtcaggcacagtggctcacacctgtaatcccagcactttactttgggaggctgacgtgggccaattgcttgagctcaggagttggagaccaggctgggcaacatatggagattctgtctctataaaaaataaaacattttagtcagtagccaggcatggtggtcctgcaatcaatcctagctactcgggaggctgaggcatgagaattgctcaaacgcgagaggcagaggttgcagtgagccaagatcgcaccactgcactccagcctggggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaa

SEQ ID NO: 7560 - DNA, 1747 bp, Artificial Sequence
  Synthetic polypeptide
ggtcaggcacagtggctcacacctgtaatcccagcactttactttgggaggctgacgtgggccaattgcttgagctcaggagttggagaccaggctgggcaacatatggagattctgtctctataaaaaataaaacattttagtcagtagccaggcatggtggtcctgcaatcaatcctagctactcgggaggctgaggcatgagaattgctcaaacgcgagaggcagaggttgcagtgagccaagatcgcaccactgcactccagcctggggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtcagaagccgcctccctcgctccctgctcctccaggaattcccagcaggctctctggtgttcagggtccttgtccctcctttcccctaagcagaaaactggccctgccctgcccctgccccatttcctcctcatctga

SEQ ID NO: 7561 - DNA, 142 bp, Artificial Sequence
  Synthetic polypeptide
gggcagctggggcacaagataagcctggacttggaggccagacccagagatgaccaagcgagacgtgcctggcttcgccatcgggggcctgagcgggggtgagagcaagtcgcagttctggcggatggtggcgctgagcacc

SEQ ID NO: 7562 - DNA, 613 bp, Artificial Sequence
  Synthetic polypeptide
gggcagctggggcacaagataagcctggacttggaggccagacccagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctga

SEQ ID NO: 7563 - DNA, 204 bp, Artificial Sequence
  Synthetic polypeptide
ccaggtgaaaggagccaggcacaaaaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctga

SEQ ID NO: 7564 - DNA, 181 bp, Artificial Sequence
  Synthetic polypeptide
ccaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctga

SEQ ID NO: 7565 - DNA, 1661 bp, Artificial Sequence
  Synthetic polypeptide
cggatcatgagtccatgaacatcctgacctccgtgctgctgctgtacaccaaggaggaggaagccttctggctgttggttgctgtgtgtgagcggatgctgcccgattacttcaaccaccgagtgatcggggcacaagttgaccagtctgtcttcgaggagctcatcaagggtcatctcccagagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcccccagttggcagccaccatgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagatgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaagggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtag

SEQ ID NO: 7566 - DNA, 1349 bp, Artificial Sequence; identical to SEQ ID NO: 7130
  Synthetic polypeptide

SEQ ID NO: 7567 - DNA, 387 bp, Artificial Sequence; identical to SEQ ID NO: 544
  Synthetic polypeptide

SEQ ID NO: 7568 - DNA, 540 bp, Artificial Sequence; identical to SEQ ID NO: 545
  Synthetic polypeptide

SEQ ID NO: 7569 - DNA, 303 bp, Artificial Sequence; identical to SEQ ID NO: 547
  Synthetic polypeptide

SEQ ID NO: 7570 - DNA, 871 bp, Artificial Sequence; identical to SEQ ID NO: 437
  Synthetic polypeptide

SEQ ID NO: 7571 - DNA, 421 bp, Artificial Sequence; identical to SEQ ID NO: 441
  Synthetic polypeptide

SEQ ID NO: 7572 - DNA, 638 bp, Artificial Sequence; identical to SEQ ID NO: 442
  Synthetic polypeptide

SEQ ID NO: 7573 - DNA, 337 bp, Artificial Sequence; identical to SEQ ID NO: 443
  Synthetic polypeptide

SEQ ID NO: 7574 - DNA, 1883 bp, Artificial Sequence; identical to SEQ ID NO: 6345
  Synthetic polypeptide

SEQ ID NO: 7575 - DNA, 1031 bp, Artificial Sequence
  Synthetic polypeptide
ggaagacctgctagagtagaaatgtcatttctccccaaacggatctatagattcattctggttccaatcaacgtccagttcagttgatttcctcccgagacttgagaagatgattctaaaatgtgtatggaagattcgagatctaagaatatctaggacacttctgaagaagacaggaagaagagacttggcctaccagatggcaagatgtgttgtaaaactgaagtcattacaataaggagctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattag

SEQ ID NO: 7576 - DNA, 1033 bp, Artificial Sequence
  Synthetic polypeptide
ccatcctgagttaagctaaactgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttga

SEQ ID NO: 7577 - DNA, 1048 bp, Artificial Sequence
  Synthetic polypeptide
ccatcctgagttaagctaaactgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacaggtacttctgcagtggaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttga

SEQ ID NO: 7578 - DNA, 3525 bp, Artificial Sequence
  Synthetic polypeptide
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctga

SEQ ID NO: 7579 - DNA, 3615 bp, Artificial Sequence
  Synthetic polypeptide
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctga

SEQ ID NO: 7580 - DNA, 3552 bp, Artificial Sequence
  Synthetic polypeptide
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtgagtcaggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctga

SEQ ID NO: 7581 - DNA, 3654 bp, Artificial Sequence
  Synthetic polypeptide
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctga

SEQ ID NO: 7582 - DNA, 3663 bp, Artificial Sequence
  Synthetic polypeptide
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtgagtcaggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctga

SEQ ID NO: 7583 - DNA, 3459 bp, Artificial Sequence
  Synthetic polypeptide
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtagttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctga

SEQ ID NO: 7584 - DNA, 2559 bp, Artificial Sequence
  Synthetic polypeptide
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcagccttgccaaactgaagcccgagaagagatga

SEQ ID NO: 7585 - DNA, 2688 bp, Artificial Sequence
  Synthetic polypeptide
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcagccttgccaaactgaagcccgagaagagatga

SEQ ID NO: 7586 - DNA, 2598 bp, Artificial Sequence
  Synthetic polypeptide
ttgtggacaatcttttcaaggatgtttgtagagcaagataggtataagatctcctctgacagcagcaagcaaagatactccctgtctgtctaaaagattcaggttccctaagcctagggttcttctgtgtgtgccagtgtccctggatcctcttcacatcaccttgtgagaatcttagctgaggaaccactacataaaaggaagatactctggctagcggtgtggctatgagttgtgaatagttctttgtctgtgacccaggaatcttctgccttctgccagcattgatgaaggtgtagctttcaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcagccttgccaaactgaagcccgagaagagatga

SEQ ID NO: 7587 - DNA, 1267 bp, Artificial Sequence; identical to SEQ ID NO: 463
  Synthetic polypeptide

SEQ ID NO: 7588 - DNA, 285 bp, Artificial Sequence; identical to SEQ ID NO: 6477
  Synthetic polypeptide

SEQ ID NO: 7589 - DNA, 238 bp, Artificial Sequence; identical to SEQ ID NO: 6378
  Synthetic polypeptide

SEQ ID NO: 7590 - DNA, 299 bp, Artificial Sequence; identical to SEQ ID NO: 485
  Synthetic polypeptide

SEQ ID NO: 7591 - DNA, 2471 bp, Artificial Sequence; identical to SEQ ID NO: 576
  Synthetic polypeptide

SEQ ID NO: 7592 - DNA, 4259 bp, Artificial Sequence
  Synthetic polypeptide
gcaaattggtaccagaagtggtatgctgctgaaaagatacccgaaaaagtagaagtgactttgaaactgggtaacaggcagaggttggaagagtttgaggggctcagaagaagacaggaaaatgtgggaaagtttggaactttctagagacttgttgaatggctttcaaccaaaatgctgtagctatatggacaataaagcccaggttgaggtggtctcagatggaaatgaggaagttgttgggaacttgagcaaaagtgactcttgctatattttagcaaaaagactggtggcattttgcccctgccctagagatttgtggaactttgaacttgagagagatgatttaggctatctggcagaagaaatttctaagcagcaaagcattcaagaggtgacttggatgctgttaaaagcattaagttttataagggaagtagagcataaaagtctggaaaatttgcagtctgacaatgcaatagaaaaggaaattccactttctggggaaaaattcaagctggctgcagaaatttgcataagtaacaagaagcctaatgttaatccccaagacaatgtggaaaatgtttccagggcaggtcagaggtcttcacagcagcctcttccatcacaggcctagaggcctaagaggaaaaaatggttttgtgggccaggcccagggtccccatgctgtgtgcagcctagggacttggtgctctgtgtcccagccactccagctgtggctgaaaggggctaatctagagcttaggccatggcttcagagggtgcaagccccaagccttggcagcttccacatagtgttgagcctgcaagtgcacagaagtcaagaattgatgtttgggaacctccctctagatttcagaagatgtgtggaaatgcccggatgcccaggcagaagtttgctgtaggtgtgttgtccttgtggagaacctctgcaagggcaataagacagggaaatgtgggatgggaggtgcctactgggtatccacctagtggagctgttgagaagagggccacagtcctccagaccctagaatggtagacccacctacagcttgcactgtgtgcctggaaaagccgcagacactcaacaccagcccatgaaagcagctgggagggtggctgtaccctgcaaagccacggggatggagctgcccaaggccatgggaacccacctcttgcataaacgttactcagatgcatgacatggagtcaaaggagatcattttggaactttaagatttgactgcattgctggattttggatttgcatggggcctgtagtgcctttgtttggctaatttctcccatttggaatggctatatttactcaatgcatatacctgcattgtatctaggaaataactaacttgcttttgattttacaggctcataggcaggcggtacttgccttgtcccagatgggactttggactgtggacttttgagttgatgcagaagatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcattccatccatttgacacagggatggacacttggccggggaatgtccagggagctctgaagctggcagccttaaagatgcaagtgcatgaaggacagtga

SEQ ID NO: 7593 - DNA, 3476 bp, Artificial Sequence
  Synthetic polypeptide
gcaaattggtaccagaagtggtatgctgctgaaaagatacccgaaaaagtagaagtgactttgaaactgggtaacaggcagaggttggaagagtttgaggggctcagaagaagacaggaaaatgtgggaaagtttggaactttctagagacttgttgaatggctttcaaccaaaatgctgtagctatatggacaataaagcccaggttgaggtggtctcagatggaaatgaggaagttgttgggaacttgagcaaaagtgactcttgctatattttagcaaaaagactggtggcattttgcccctgccctagagatttgtggaactttgaacttgagagagatgatttaggctatctggcagaagaaatttctaagcagcaaagcattcaagaggtgacttggatgctgttaaaagcattaagttttataagggaagtagagcataaaagtctggaaaatttgcagtctgacaatgcaatagaaaaggaaattccactttctggggaaaaattcaagctggctgcagaaatttgcataagtaacaagaagcctaatgttaatccccaagacaatgtggaaaatgtttccagggcaggtcagaggtcttcacagcagcctcttccatcacaggcctagaggcctaagaggaaaaaatggttttgtgggccaggcccagggtccccatgctgtgtgcagcctagggacttggtgctctgtgtcccagccactccagctgtggctgaaaggggctaatctagagcttaggccatggcttcagagggtgcaagccccaagccttggcagcttccacatagtgttgagcctgcaagtgcacagaagtcaagaattgatgtttgggaacctccctctagatttcagaagatgtgtggaaatgcccggatgcccaggcagaagtttgctgtaggtgtgttgtccttgtggagaacctctgcaagggcaataagacagggaaatgtgggatgggaggtgcctactgggtatccacctagtggagctgttgagaagagggccacagtcctccagaccctagaatggtagacccacctacagcttgcactgtgtgcctggaaaagccgcagacactcaacaccagcccatgaaagcagctgggagggtggctgtaccctgcaaagccacggggatggagctgcccaaggccatgggaacccacctcttgcataaacgttactcagatgcatgacatggagtcaaaggagatcattttggaactttaagatttgactgcattgctggattttggatttgcatggggcctgtagtgcctttgtttggctaatttctcccatttggaatggctatatttactcaatgcatatacctgcattgtatctaggaaataactaacttgcttttgattttacaggctcataggcaggcggtacttgccttgtcccagatgggactttggactgtggacttttgagttgatgcagaagatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccaccaaactccgtcaaaaaaaaacaaaacaaaacaaaaaaaagacatgggagagatggtgtttttcctctccaccacctggggatacgatga

SEQ ID NO: 7594 - DNA, 3497 bp, Artificial Sequence
  Synthetic polypeptide
gcaaattggtaccagaagtggtatgctgctgaaaagatacccgaaaaagtagaagtgactttgaaactgggtaacaggcagaggttggaagagtttgaggggctcagaagaagacaggaaaatgtgggaaagtttggaactttctagagacttgttgaatggctttcaaccaaaatgctgtagctatatggacaataaagcccaggttgaggtggtctcagatggaaatgaggaagttgttgggaacttgagcaaaagtgactcttgctatattttagcaaaaagactggtggcattttgcccctgccctagagatttgtggaactttgaacttgagagagatgatttaggctatctggcagaagaaatttctaagcagcaaagcattcaagaggtgacttggatgctgttaaaagcattaagttttataagggaagtagagcataaaagtctggaaaatttgcagtctgacaatgcaatagaaaaggaaattccactttctggggaaaaattcaagctggctgcagaaatttgcataagtaacaagaagcctaatgttaatccccaagacaatgtggaaaatgtttccagggcaggtcagaggtcttcacagcagcctcttccatcacaggcctagaggcctaagaggaaaaaatggttttgtgggccaggcccagggtccccatgctgtgtgcagcctagggacttggtgctctgtgtcccagccactccagctgtggctgaaaggggctaatctagagcttaggccatggcttcagagggtgcaagccccaagccttggcagcttccacatagtgttgagcctgcaagtgcacagaagtcaagaattgatgtttgggaacctccctctagatttcagaagatgtgtggaaatgcccggatgcccaggcagaagtttgctgtaggtgtgttgtccttgtggagaacctctgcaagggcaataagacagggaaatgtgggatgggaggtgcctactgggtatccacctagtggagctgttgagaagagggccacagtcctccagaccctagaatggtagacccacctacagcttgcactgtgtgcctggaaaagccgcagacactcaacaccagcccatgaaagcagctgggagggtggctgtaccctgcaaagccacggggatggagctgcccaaggccatgggaacccacctcttgcataaacgttactcagatgcatgacatggagtcaaaggagatcattttggaactttaagatttgactgcattgctggattttggatttgcatggggcctgtagtgcctttgtttggctaatttctcccatttggaatggctatatttactcaatgcatatacctgcattgtatctaggaaataactaacttgcttttgattttacaggctcataggcaggcggtacttgccttgtcccagatgggactttggactgtggacttttgagttgatgcagaagatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagttcgtggcttcagaagggaagaacagattttttcaaatgtcatgaaatttccttttgccagcatcctggaactataa

SEQ ID NO: 7595 - DNA, 3050 bp, Artificial Sequence
  Synthetic polypeptide
tgatgtggcttggctgtgtccccacccacatctcatcttgaattcccacctgttgtgggaggaacccagtgggaggtaattgaatgatgggggcagatctttcctgtgctgtcctcatgatagtgagtaagtctcacactatctgatggttttaaaaagggaagtttcccttcacaagctcatttcttgcctgctgccatccatgtaagatgtgacttgctcctccttgtcttccaccatgattgtgaggcttccagctacatgaaactgatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcattccatccatttgacacagggatggacacttggccggggaatgtccagggagctctgaagctggcagccttaaagatgcaagtgcatgaaggacagtga

SEQ ID NO: 7596 - DNA, 2267 bp, Artificial Sequence
  Synthetic polypeptide
tgatgtggcttggctgtgtccccacccacatctcatcttgaattcccacctgttgtgggaggaacccagtgggaggtaattgaatgatgggggcagatctttcctgtgctgtcctcatgatagtgagtaagtctcacactatctgatggttttaaaaagggaagtttcccttcacaagctcatttcttgcctgctgccatccatgtaagatgtgacttgctcctccttgtcttccaccatgattgtgaggcttccagctacatgaaactgatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccaccaaactccgtcaaaaaaaaacaaaacaaaacaaaaaaaagacatgggagagatggtgtttttcctctccaccacctggggatacgatga

SEQ ID NO: 7597 - DNA, 2288 bp, Artificial Sequence
  Synthetic polypeptide
tgatgtggcttggctgtgtccccacccacatctcatcttgaattcccacctgttgtgggaggaacccagtgggaggtaattgaatgatgggggcagatctttcctgtgctgtcctcatgatagtgagtaagtctcacactatctgatggttttaaaaagggaagtttcccttcacaagctcatttcttgcctgctgccatccatgtaagatgtgacttgctcctccttgtcttccaccatgattgtgaggcttccagctacatgaaactgatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagttcgtggcttcagaagggaagaacagattttttcaaatgtcatgaaatttccttttgccagcatcctggaactataa

SEQ ID NO: 7598 - DNA, 116 bp, Artificial Sequence
  Synthetic polypeptide
cagagaccaagttcattctgtcaactgatctccagcacctggcccagagacggaaagtacaaagactagtaaaatacatccttgcccttaaggagctaagtacccaaaacctgtaa

SEQ ID NO: 7599 - DNA, 1025 bp, Artificial Sequence
  Synthetic polypeptide
ggccaggcacagtggcccacgcctgtaatcccagcactttgggaggccaaggcaggtggatcacctgaggtcagccgttcgagaccagcctggccaacgtggtgaaaccctgtctctactaaaaatacaaaaattagccggggtggtggcaggtgcctgtaatcccagctgctcaggaggctgagctgctaaaaggagtgaccatcgccagtggaggcgtcctgcccagaattcaccccgaactgctggccaaaaagcgagggaccaaaggcaagtcggaaacgatcctctccccacccccagagaaaagaggcaggaaggccacgtcaggcaagaagggggggaagaaatccaaggctgccaaaccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtag

SEQ ID NO: 7600 - DNA, 200 bp, Artificial Sequence
  Synthetic polypeptide
ccacaaacaaaaatgaacaaaatagggaaataggctatattgttaagtgaaaaagcagaacacagaatactactgttctatcacattgggtatctagatacatagaaaaaagactggaaggacattcacacatcaaaacgggtgacacatctggagactacaggaaagtactgcttgttctctgtggaggagatgattaa

SEQ ID NO: 7601 - DNA, 274 bp, Artificial Sequence
  Synthetic polypeptide
tttatctctcaggcttcatctgtgaaatgaatgggagtaacagcaacatccacctcacaggttcagggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtgggggagatggacccgtttaa

SEQ ID NO: 7602 - DNA, 158 bp, Artificial Sequence
  Synthetic polypeptide
gtggtggctcatgcctgtaatttcagcactttgggaggccaaggcaggcggatcacttgaggttctgtttggattctgcaaagcagactcgtcagaaagttgctgtgaactggaccaacttcagcctcaagaaaaccactcctagcacagctcagtga

SEQ ID NO: 7603 - DNA, 520 bp, Artificial Sequence
  Synthetic polypeptide
ccccccacttcccttctcccctttcttatccctcaagcctcagccaaaagcctgcttctttagggcagtctttcctgaccatcctatctaaggtgtccttacttgttattcttagatctctgtaccttgtctgattttttcacagctcttggatttggtgattctttgtgaattgttacacctgatggtctttctccaccactagatgaacgtgtactacacgagcagtcagcagatccatgtgggcattctgagccccaccgtggatgatgatgacaaccgatgcctggtggacgtcaacagccggccccggctcatcgaatgcagctacgccaaagccaagaggatgaagcttcactggcagttctctcagggaggacccatccagaaccgcaagtctaagcgctgtctggagctgcaggagaatagcgacctggagttcggcttccagctggtgttgcagaagtgctcgggccagcactggagcatcaccaacgtcctgaggagcctcgcgtcctga

SEQ ID NO: 7604 - DNA, 330 bp, Artificial Sequence
  Synthetic polypeptide
ggccgggcgcggttgctcacgcctgtaatcccaacactttgggaggctaagccagatggatcacctgaggccaaatttgagtttcatcatggtgactatgaaaaacagtttctgcatgtactgagccgcaaggacaagactggaatcgttgtcaacaatcctaaccagtcagtgtttctcttcattgacagacagcacttgcagactccaaaaaacaaagctacaatcttcaagttatgcagcatctgcctctacctgccacaggaacagctcacccactgggcagttggcaccatagaggatcacctccgtccttatatgccagagtag

SEQ ID NO: 7605 - DNA, 1384 bp, Artificial Sequence
  Synthetic polypeptide
ggcgaggcacggtggctcacgcctgtaatcccagcactttggaaggccaaggcgggcagatcacgagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtga

SEQ ID NO: 7606 - DNA, 1683 bp, Artificial Sequence
  Synthetic polypeptide
tgccacagaagtttcactgggaaggctgaagctcttcttcagcaaaatggcgacttcctggttcgcgcctctgggtcccgtgggggcaaccccgtgatctcctgccgctggcggggctcagccctccattttgaggtgttccgtgtggccctgcgtccccggccaggccgacccacagccctctttcaactggaggatgagcaattccccagcataccggctctggttcacagttatatgacaggcaggcgcccactgtcccaggccacaggggctgtggtctccaggcctgtgacttggcaggggcctctgcgacgcagctttagcgaggacaccctgatggatggcccagctcggatagagcctctcagggcaaggaagtggagcaacagtcagcctgcagatttggcacatatggggcggtcaagagaagaccccgctgggatggaagcctccaccatgcccatatctgccttgccccgaacgagcagtgacccggtgttgctgaaggcccctgctcccctgggaactgttgccgacagtctcagggcctccgatgggcagcttcaagccaaggcaccaacgaagcccccccggacaccctccttcgaactgcctgatgcctctgaacgtcccccgacgtactgcgagctggtgccccgagtgcccagtgtccagggaacatccccgagccaaagctgcccagagccagaggccccatggtgggaggccgaggaggatgaggaggaagagaatagatgttttacaagaccacaggctgagatctctttctgcccccatgatgccccctcctgcctgctgggcccccagaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagaggcatcagacactggcgctggccggggcgctggcggtgctgggctgctcggggccgctggaggagcgcgcagccgcactgaggggactggtagagctggcgctggcgctgcggccaggggcggcgggggacctgcccgggctggctgcagtcatgggcgccctgctcatgccccaggtgtcccggttggagcacacgtggcgccagctccgaaggagccacacggaggctgcgctggcctttgagcaggagctgaagccgctgatgcgggctctggatgagggcgctggaccctgcgaccccggcgaggtggcgctgccgcacgtggcacccatggttcgcctactggagggcgaggaagtcgcggggccgctggacgagagctgtgagcggctgttgcgcaccctgcacggggcgcgtcacatggtccgggacgcacccaaattccgcaaggtggcagcccagcgcctgcgaggattccggcctaacccggagctgagggaggccctgaccaccggcttcgtgcggaggctgctctggggtagccggggcgcgggagctccgcgcgctgaacgctttgagaagttccagcgcgtcctcggcgtcctgtcgcagcgcctggagcctgaccgctga

SEQ ID NO: 7607 - DNA, 666 bp, Artificial Sequence
  Synthetic polypeptide
tgccacagaagtttcactgggaaggctgaagctcttcttcagcaaaatggcgacttcctggttcgcgcctctgggtcccgtgggggcaaccccgtgatctcctgccgctggcggggctcagccctccattttgaggtgttccgtgtggccctgcgtccccggccaggccgacccacagccctctttcaactggaggatgagcaattccccagcataccggctctggttcacagttatatgacaggcaggcgcccactgtcccaggccacaggggctgtggtctccaggcctgtgacttggcaggggcctctgcgacgcagctttagcgaggacaccctgatggatggcccagctcggatagagcctctcagggcaaggaagtggagcaacagtcagcctgcagatttggcacatatggggcggtcaagagaagaccccgctgggatggaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagag

SEQ ID NO: 7608 - DNA, 2309 bp, Artificial Sequence
  Synthetic polypeptide
gccgggtgcagtggctcaagcctgtaatctcagcactttgggaggctgaggcggatggatcacaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctga

SEQ ID NO: 7609 - DNA, 2389 bp, Artificial Sequence
  Synthetic polypeptide
gccgggtgcagtggctcaagcctgtaatctcagcactttgggaggctgaggcggatggatcacaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtggtgctgtaaggggtgactggagggagaagcctggctgctggtcacaccgcttcccttgtcctggccggcatgctctggtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctga

SEQ ID NO: 7610 - DNA, 771 bp, Artificial Sequence
  Synthetic polypeptide
gcctggctcggcggctcacgcctgtaaccgcagcactgggaggccaaggcgggaggatccctttagcccacgagttcgagacaagcctgggcaacacctcaaaaccccatctctacaaaaaacataaaaattatctggatgtggtggtgtgtgcctgtggtcccagctactctggaggctgaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctag

SEQ ID NO: 7611 - DNA, 5853 bp, Artificial Sequence
  Synthetic polypeptide
acagaagggtgcagtggtagtgtgaactccagacttggaacacctgggttcagatcttagctctaccacttaccagctgtgtcatatgggacaaatcccttaacctctctgggcctctagaaacagatacagttatagcactcacctcatatgcttaacagagttaaaaaatgttaaactctctgaacagtgcctggcacatactaagcgctacataaaggcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtgaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccagtggcggccagaggagtccgaggactatgaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtgcccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaa

SEQ ID NO: 7612 - DNA, 5826 bp, Artificial Sequence
  Synthetic polypeptide
acagaagggtgcagtggtagtgtgaactccagacttggaacacctgggttcagatcttagctctaccacttaccagctgtgtcatatgggacaaatcccttaacctctctgggcctctagaaacagatacagttatagcactcacctcatatgcttaacagagttaaaaaatgttaaactctctgaacagtgcctggcacatactaagcgctacataaaggcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtgaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtgcccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggtgatttctggaggatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctacgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaa

SEQ ID NO: 7613 - DNA, 917 bp, Artificial Sequence
  Synthetic polypeptide
acagaagggtgcagtggtagtgtgaactccagacttggaacacctgggttcagatcttagctctaccacttaccagctgtgtcatatgggacaaatcccttaacctctctgggcctctagaaacagatacagttatagcactcacctcatatgcttaacagagttaaaaaatgttaaactctctgaacagtgcctggcacatactaagcgctacataaaggcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgaggtcttgccgcatgggcccggagccccatgggaatttggagccatccaatccgacttcttggtgtatgtgcatgtgtgtgtgcacacacgggcacacttatctgtgtgta

SEQ ID NO: 7614 - DNA, 1423 bp, Artificial Sequence; identical to SEQ ID NO: 6512
  Synthetic polypeptide

SEQ ID NO: 7615 - DNA, 1631 bp, Artificial Sequence
  Synthetic polypeptide
gccaggtgcggtgactcacgcctgtaatcccagcactttggaaggccaaggcgggtggatagcaaggtcaagagatcgagaccagcctggccaacatgctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggaggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactag

SEQ ID NO: 7616 - DNA, 346 bp, Artificial Sequence
  Synthetic polypeptide
gaaccataggaaacagctgatatccaaccatttttgaacctacacaggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactga

SEQ ID NO: 7617 - DNA, 123 bp, Artificial Sequence
  Synthetic polypeptide
ggtacagtggctcacacctgtcatcccagcactttgccaagacagccctgcacctccgggctcggcggaacttccgggacttcaggggagtgtcccgccgcactggggaggagtggctggtaa

SEQ ID NO: 7618 - DNA, 2051 bp, Artificial Sequence
  Synthetic polypeptide
ggtacagtggctcacacctgtcatcccagcactttgccaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaa

SEQ ID NO: 7619 - DNA, 406 bp, Artificial Sequence
  Synthetic polypeptide
ggtacagtggctcacacctgtcatcccagcactttgccaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatga

SEQ ID NO: 7620 - DNA, 458 bp, Artificial Sequence
  Synthetic polypeptide
actacatttcccaagcttctttgcactttgatttccacccaggtcaaccaatgggaggtactgtcaggagaatgatggcggggaggaaggatgaagccagagtactatttcctctttctttaccacggcagaggctctggctgtgactatgtctcctcatggccactaatgtgtccgccaccttgaccttcaataccagcaagatcactgggttcctgaagccaggaaaggtaaaagtggaactgaaagaatccaaagttggactattcaatgcagagctgttggaagcgctcctcaactattacatccttaacaccttctaccccaagttcaatgataagttggccgaaggcttcccccttcctctgctgaagcgtgttcagctctacgaccttgggctgcagatccataaggacttcctgttcttgggtgccaatgtccaatacatgagagtttga

SEQ ID NO: 7621 - DNA, 282 bp, Artificial Sequence
  Synthetic polypeptide
ggccgggtgcggtggctcacacctgtaatcctagcatcttgggaggctgaggcaggaggatcgcttgagcccaggagtttgagaccagcctaggcaacataaggagaccccatctctacaaaatatcaaaaaattacccaggtatggtggcacacacgtgtgattccagctactcgggaggctgagatgggaggatcacttgaacccaggaggttggggctacaatgagctatgatcgcaccacttcattccagcctggatgacagaagactcactccatag

SEQ ID NO: 7622 - DNA, 1227 bp, Artificial Sequence
  Synthetic polypeptide
ccgaggatcagagatgtcctagtcccagctcatccaccaacttgccatatgactttgggcaagttacctcaccttcagatgcctccattggaaaagaatacaaggaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctag

SEQ ID NO: 7623 - DNA, 536 bp, Artificial Sequence
  Synthetic polypeptide
ggtcaggcatggtggcgcatgtctgtaatcccagcactttgggaggccaatgcaggcgggttacttgagacgaggagtttgagaccagcctgggcaacacagtgagacccccatctctataaaaaaaaaaaaaaaccaattagctgggctcagtgacatgtacctatagtcccagctacttgggaaactgacatggaaagattgcttgagcccaggagtttgaggctgcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttga

SEQ ID NO: 7624 - DNA, 889 bp, Artificial Sequence
  Synthetic polypeptide
ggccggtgtggtggctcacgcctgaaatcccagcactttgggaggctgagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcattccatccatttgacacagggatggacacttggccggggaatgtccagggagctctgaagctggcagccttaaagatgcaagtgcatgaaggacagtga

SEQ ID NO: 7625 - DNA, 844 bp, Artificial Sequence
  Synthetic polypeptide
ggccggtgtggtggctcacgcctgaaatcccagcactttgggaggctgagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcattccatccatttgacacagggatgcttggccggggaatgtccagggagctctga

SEQ ID NO: 7626 - DNA, 742 bp, Artificial Sequence; identical to SEQ ID NO: 6357
  Synthetic polypeptide

SEQ ID NO: 7627 - DNA, 590 bp, Artificial Sequence; identical to SEQ ID NO: 6358
  Synthetic polypeptide

SEQ ID NO: 7628 - DNA, 577 bp, Artificial Sequence; identical to SEQ ID NO: 6359
  Synthetic polypeptide

SEQ ID NO: 7629 - DNA, 430 bp, Artificial Sequence; identical to SEQ ID NO: 6360
  Synthetic polypeptide

SEQ ID NO: 7630 - DNA, 670 bp, Artificial Sequence; identical to SEQ ID NO: 6361
  Synthetic polypeptide

SEQ ID NO: 7631 - DNA, 2284 bp, Artificial Sequence
  Synthetic polypeptide
gtggccaaccacatgggcctggagctgggttcaaaccctgactttggcactacttattagctgtgtgaccttgggacagttaattaccactctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggggaagtcgcggccactgcctgtgtga

SEQ ID NO: 7632 - DNA, 2263 bp, Artificial Sequence
  Synthetic polypeptide
gtggccaaccacatgggcctggagctgggttcaaaccctgactttggcactacttattagctgtgtgaccttgggacagttaattaccactctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctga

SEQ ID NO: 7633 - DNA, 459 bp, Artificial Sequence
  Synthetic polypeptide
gtggccaaccacatgggcctggagctgggttcaaaccctgactttggcactacttattagctgtgtgaccttgggacagttaattaccactctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaa

SEQ ID NO: 7634 - DNA, 400 bp, Artificial Sequence
  Synthetic polypeptide
gtggccaaccacatgggcctggagctgggttcaaaccctgactttggcactacttattagctgtgtgaccttgggacagttaattaccactctgcaggtagaacacctgaaggagaagctcattagccaggcccaggaagtgagccgactgcgatctgagctgcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggct

SEQ ID NO: 7635 - DNA, 270 bp, Artificial Sequence
  Synthetic polypeptide
gtggccaaccacatgggcctggagctgggttcaaaccctgactttggcactacttattagctgtgtgaccttgggacagttaattaccactctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaa

SEQ ID NO: 7636 - DNA, 220 bp, Artificial Sequence
  Synthetic polypeptide
gtggccaaccacatgggcctggagctgggttcaaaccctgactttggcactacttattagctgtgtgaccttgggacagttaattaccactctgcaggtagaacacctgaaggagaagctcattagccaggcccaggaagtgagccgactgcgatctgagctggggggcaccgacttggagaagcaccgggacctgctgatggtggagaatgagcgactg

SEQ ID NO: 7637 - DNA, 179 bp, Artificial Sequence
  Synthetic polypeptide
gtggccaaccacatgggcctggagctgggttcaaaccctgactttggcactacttattagctgtgtgaccttgggacagttaattaccactctgcaggtagaacacctgaaggagaagctcattagccaggcccaggaagtgagccgactgcgatctgagctggggggcaccgacttgg

SEQ ID NO: 7638 - DNA, 186 bp, Artificial Sequence
  Synthetic polypeptide
cgtggtgggcaagagcatgagcttggaaccggaggcctcgatcctcgccagctgtgtggcctcagggtcccgacggcctacacatggggcgctgtgggcgccgtggggctggtgtgggccaccgattggcggctgatcctggactgggtaccttacatcaatggcaagtttaagaaggataattaa

SEQ ID NO: 7639 - DNA, 163 bp, Artificial Sequence; identical to SEQ ID NO: 480
  Synthetic polypeptide

SEQ ID NO: 7640 - DNA, 104 bp, Artificial Sequence; identical to SEQ ID NO: 481
  Synthetic polypeptide

SEQ ID NO: 7641 - DNA, 820 bp, Artificial Sequence
  Synthetic polypeptide
gagaggtcggatctttaagatgtaattaggtcatgagaactccaccatcataaacagattactgctgttatcatgggagtggtttggttatcaagagactgggtttgttataaaagtgagttctccggatttcctctctgacttactcactgctgccttccaccatcagatgatcctcaccagatgccagcataatattcttggatttgcctgcctctagaagtaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttag

SEQ ID NO: 7642 - DNA, 946 bp, Artificial Sequence
  Synthetic polypeptide
gagaggtcggatctttaagatgtaattaggtcatgagaactccaccatcataaacagattactgctgttatcatgggagtggtttggttatcaagagactgggtttgttataaaagtgagttctccggatttcctctctgacttactcactgctgccttccaccatcagatgatcctcaccagatgccagcataatattcttggatttgcctgcctctagaagtaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacaggaatttcacctattacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttag

SEQ ID NO: 7643 - DNA, 1267 bp, Artificial Sequence; identical to SEQ ID NO: 463
  Synthetic polypeptide

SEQ ID NO: 7644 - DNA, 382 bp, Artificial Sequence; identical to SEQ ID NO: 434
  Synthetic polypeptide

SEQ ID NO: 7645 - DNA, 1086 bp, Artificial Sequence; identical to SEQ ID NO: 6423
  Synthetic polypeptide

SEQ ID NO: 7646 - DNA, 2419 bp, Artificial Sequence; identical to SEQ ID NO: 7455
  Synthetic polypeptide

SEQ ID NO: 7647 - DNA, 742 bp, Artificial Sequence; identical to SEQ ID NO: 6357
  Synthetic polypeptide

SEQ ID NO: 7648 - DNA, 590 bp, Artificial Sequence; identical to SEQ ID NO: 6358
  Synthetic polypeptide

SEQ ID NO: 7649 - DNA, 577 bp, Artificial Sequence; identical to SEQ ID NO: 6359
  Synthetic polypeptide

SEQ ID NO: 7650 - DNA, 430 bp, Artificial Sequence; identical to SEQ ID NO: 6360
  Synthetic polypeptide

SEQ ID NO: 7651 - DNA, 670 bp, Artificial Sequence; identical to SEQ ID NO: 6361
  Synthetic polypeptide

SEQ ID NO: 7652 - DNA, 1086 bp, Artificial Sequence; identical to SEQ ID NO: 444
  Synthetic polypeptide

SEQ ID NO: 7653 - DNA, 564 bp, Artificial Sequence; identical to SEQ ID NO: 445
  Synthetic polypeptide

SEQ ID NO: 7654 - DNA, 987 bp, Artificial Sequence; identical to SEQ ID NO: 446
  Synthetic polypeptide

SEQ ID NO: 7655 - DNA, 1138 bp, Artificial Sequence
  Synthetic polypeptide
tgttataggaaatagaaataaagtatttgggtagacggggagaagagagtccctggcagaaaactttccttctaacataaagtagctcagaaatagctcccttctaacctcatgcagttcaaagaaatcacttctctaactaaacaagcagcctgaaagatcaggctgtaaatcacagataaacccctggagcacagaaggagggcggggagtctcctgggtaatcaccaaacttcacaatgggccccagtaaaaacagtgggccttaataagcacattcctttccctttaggacatcaagatagagaagctaaaagtggacttggggaggtgggggtggagacgtcgtgggggaggggtgttggggggatgcctgcagctgcaagaagatgtctgggaacagacacagaaactctccctctcagataagcaaaagaaggcatcacagactaagtctgcccatgtgatccaggaataaagtgagagctgataaaaaaaaaaactctgctctataaagatagcacacctggtcccaactaaatcgtcaggccctaggaggataagacatcccctcctcactggcaccacccccgccacctgccactaactccctcctcactagcccatttataaaaaccctgacatttttactaagcaactcactcgggacccatctcttcaagggagagctgttctttctttttgcctattcaactttgctccaaactcaagtctgtgtgtgtagtgtgtgttcgcgacctccgtctccttgactgttcgaccaagagccttggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattga

SEQ ID NO: 7656 - DNA, 3021 bp, Artificial Sequence; identical to SEQ ID NO: 449
  Synthetic polypeptide

SEQ ID NO: 7657 - DNA, 3075 bp, Artificial Sequence; identical to SEQ ID NO: 450
  Synthetic polypeptide

SEQ ID NO: 7658 - DNA, 1143 bp, Artificial Sequence; identical to SEQ ID NO: 451
  Synthetic polypeptide

SEQ ID NO: 7659 - DNA, 470 bp, Artificial Sequence
  Synthetic polypeptide
gccatgttgatttctcattagccccagtctcgtgaatgcctcctgattctgattttatttactgtttttagtgtaagaacaaagcagccttgatcttaccacacaaattataggcagtgacgcacatagcattcccacctgttctggaggatgcctttaattgcctctgtagagcacgtacaccctttccctgtggcatataagctctgggtctggccagtaacagagtgggttatacctgtcttgcagccatccgagatcacgcttcttgtctttctcgagaagcaggtggaaacatgagcattcagtttcttggtacagtggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatga

SEQ ID NO: 7660 - DNA, 611 bp, Artificial Sequence
  Synthetic polypeptide
gccatgttgatttctcattagccccagtctcgtgaatgcctcctgattctgattttatttactgtttttagtgtaagaacaaagcagccttgatcttaccacacaaattataggcagtgacgcacatagcattcccacctgttctggaggatgcctttaattgcctctgtagagcacgtacaccctttccctgtggcatataagctctgggtctggccagtaacagagtgggttatacctgtcttgcagccatccgagatcacgcttcttgtctttctcgagaagcaggtggaaacatgagcattcagtttcttggtacagtgtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatga

SEQ ID NO: 7661 - DNA, 347 bp, Artificial Sequence
  Synthetic polypeptide
gccatgttgatttctcattagccccagtctcgtgaatgcctcctgattctgattttatttactgtttttagtgtaagaacaaagcagccttgatcttaccacacaaattataggcagtgacgcacatagcattcccacctgttctggaggatgcctttaattgcctctgtagagcacgtacaccctttccctgtggcatataagctctgggtctggccagtaacagagtgggttatacctgtcttgcagccatccgagatcacgcttcttgtctttctcgagaagcaggtggaaacatgagcattcagtttcttggtacagtgccctggagaaagcttctggattga

SEQ ID NO: 7662 - DNA, 2319 bp, Artificial Sequence; identical to SEQ ID NO: 6366
  Synthetic polypeptide

SEQ ID NO: 7663 - DNA, 366 bp, Artificial Sequence
  Synthetic polypeptide
agcatgggcaacaaagagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatag

SEQ ID NO: 7664 - DNA, 999 bp, Artificial Sequence
  Synthetic polypeptide
gggcaggaaatgtataagagaagctggaaaatcttgtcacaccagaaagcaaagaaactgtcaaagaccaatgtactcatttcagaaagactcaggacccacttgaaaggtctcccactagtcaaagatgatataatttgatttaaaaaacaaataaatgattaaaacacctaaaatatgttaaaatctgtaaggtcataatgataatcataataacaaacctggtagtcccttttataggatgctagagcaccaaatcactattcacaaaactgataaataggaagaagtaagcatttaccctgttccctgtacaaattatacttcaaagtcaccaattaattgatgaaagaaaactttacagaagaattgtaactaatatattagaaggattatagaataatattatcatcatttgagtttcaacacattcattaacccttataccacagaaagatgcaagaagagcaaaccaccacctctggggcatccttgtcaaaaaattgaacctgaatctgatcaagtctctagttagaactactagtttgcaagaaatacagagggcagagaaacatgttaaatgacaccataaggctgcaatcacaaaaatccaaaatgtgagaaatgctacaggacaaagaacccagtttctttaacaaatgaattgcaaggagaaaagaaagaagagtatgctgtgaattaatagatttgaggaacatcaaataaaatgggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacagaagccatccttacaagcacagcttccgcgctcgaggttccgccagttactccccgccacgaaagcggagcagccaggacaagtacgaaaagcggtccaaccggcggtga

SEQ ID NO: 7665 - DNA, 527 bp, Artificial Sequence
  Synthetic polypeptide
ggctgggtgcggtggctcacgcctgtaatcccagcactttgggaggttgaggcaggtggatcacctgaggtcaggagttcgacaccagcctggccaatatagtgaaaccctgtctctagtaaaaatacaattagctgggcgtggtggcgggtgcctgtaatccagctactccggaggctgaggcaggagaatcgcttgaacctgggagacagaggttatgccactggacggatgtccaggtgaaggggacgtcgctgccccgagcactgcactgctgggacaggagcctccatgacagccacaaggccagcaagacccccctcaagggctgccccgtccacctggtggacagctgcccctggccccactgcaacccctcatgccccaccgtccgagaccagttcacggggcaagagatgaacgtggcccagttcctcatgcacatgggcttcgacatgcagacggtggcccagccgcagggactggagcccagtgagctgctggggatgctgagcaacggaagctag

SEQ ID NO: 7666 - DNA, 451 bp, Artificial Sequence
  Synthetic polypeptide
tggaaccttgtgcagagggaagagtaaaaagacctccacacggcccactctgtccaccatctttgctccaaaagtccctaccctggaagtaccggcaccagaagccgtatcctcagggcactcaacgctgcctccccttgtgtcccggcctggaagtgccgacacgcccagtgaggccgaacagaggttccggaagaagcggaggcggtcacagcggaggccgcgactccggcaattcagcgatctgtgggtccgcctggaggagagtgacatagtcccgcaactccaggtccctgtcctggacaggcacatctccactgaactgcggctccctcgccgtgggcattcccaccacagccagatggtggccagcagtgcctgcctgtctctctggactcctgtgttctgggtgctggtgctggctttccaaacagagacacccctcctgtaa

SEQ ID NO: 7667 - DNA, 769 bp, Artificial Sequence; identical to SEQ ID NO: 6486
  Synthetic polypeptide

SEQ ID NO: 7668 - DNA, 161 bp, Artificial Sequence
  Synthetic polypeptide
aagaacatcatggtgcagtaaaagaagcctggcctttggagtcagaacagcagggtgacttggggtcagacccagagcaccccatttccttctctgtaagatgaggataataagagtaacaaccttttagggttaagcccctgtctatcaaaagttattag

SEQ ID NO: 7669 - DNA, 178 bp, Artificial Sequence
  Synthetic polypeptide
aagaacatcatggtgcagtaaaagaagcctggcctttggagtcagaacagcagggtgacttggggtcagacccagagcaccccatttccttctctgtaagatgaggataataagagtaacaaccttttagggttaagcccctgtctatcaaaagttattagagaggatgaagcattag

SEQ ID NO: 7670 - DNA, 1206 bp, Artificial Sequence
  Synthetic polypeptide
tgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 7671 - DNA, 1134 bp, Artificial Sequence
  Synthetic polypeptide
tgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 7672 - DNA, 1002 bp, Artificial Sequence
  Synthetic polypeptide
tgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactgagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagtgggggaaatag

SEQ ID NO: 7673 - DNA, 279 bp, Artificial Sequence
  Synthetic polypeptide
ttccccctcatctgaggtttcactttccacagtttcagttaccagaggtccaccacagtctgaatgtattaaataggaaattccagaagcaaacagttcataacctttaaagcacgcgccgttctgcacagtctggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctga

SEQ ID NO: 7674 - DNA, 543 bp, Artificial Sequence; identical to SEQ ID NO: 6496
  Synthetic polypeptide

SEQ ID NO: 7675 - DNA, 378 bp, Artificial Sequence; identical to SEQ ID NO: 6497
  Synthetic polypeptide

SEQ ID NO: 7676 - DNA, 267 bp, Artificial Sequence; identical to SEQ ID NO: 6498
  Synthetic polypeptide

SEQ ID NO: 7677 - DNA, 416 bp, Artificial Sequence; identical to SEQ ID NO: 6499
  Synthetic polypeptide

SEQ ID NO: 7678 - DNA, 162 bp, Artificial Sequence; identical to SEQ ID NO: 6500
  Synthetic polypeptide

SEQ ID NO: 7679 - DNA, 1926 bp, Artificial Sequence
  Synthetic polypeptide
gctggtgcggctgtgcgggcggggccggaagtgtggggacagcgcggggccgagaaccggaagtgcggggcgggcgcgggggcagagcgaaaggcttgaggaccagcccaggtggggaagacgtcgctgatcctgtccctggtgggcgaggagttccccgaggaggtccctccccgcgcggaggagatcaccatccccgcggacgtcaccccggagaaggtgcccacccacatcgtggactactcagaagccgagcagacggacgaggagctgcgggaggagatccacaaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatggacaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtga

SEQ ID NO: 7680 - DNA, 477 bp, Artificial Sequence
  Synthetic polypeptide
gctggtgcggctgtgcgggcggggccggaagtgtggggacagcgcggggccgagaaccggaagtgcggggcgggcgcgggggcagagcgaaaggcttgaggaccagcccaggtggggaagacgtcgctgatcctgtccctggtgggcgaggagttccccgaggaggtccctccccgcgcggaggagatcaccatccccgcggacgtcaccccggagaaggtgcccacccacatcgtggactactcagaagccgagcagacggacgaggagctgcgggaggagatccacaaggcaaacgtggtgtgtgtggtgtatgacgtctctgaggaggccaccattgagaagattcgaactaagtggatcccactggtgaatggggggaccacgcaggggcccagtgggcaacaagtcagacctgcggtcggggagctccatggaggccgtgctccccatcatgagccagtttcccgagattga

SEQ ID NO: 7681 - DNA, 711 bp, Artificial Sequence
  Synthetic polypeptide
gctggtgcggctgtgcgggcggggccggaagtgtggggacagcgcggggccgagaaccggaagtgcggggcgggcgcgggggcagagcgaaaggcttgaggaccagcccaggtggggaagacgtcgctgatcctgtccctggtgggcgaggagttccccgaggaggtccctccccgcgcggaggagatcaccatccccgcggacgtcaccccggagaaggtgcccacccacatcgtggactactcagaagccgagcagacggacgaggagctgcgggaggagatccacaaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagaaatcctgctttgggcaccccctggccccgcaggccctggaggacgtgaagacggtggtgtgcaggaacgtggcgggcggcgtgcgggaggaccggctgacc

SEQ ID NO: 7682 - DNA, 288 bp, Artificial Sequence
  Synthetic polypeptide
gctggtgcggctgtgcgggcggggccggaagtgtggggacagcgcggggccgagaaccggaagtgcggggcgggcgcgggggcagagcgaaaggcttgaggaccagcccaggtggggaagacgtcgctgatcctgtccctggtgggcgaggagttccccgaggagccgagcagacggacgaggagctgcgggaggagatccacaaggcaaacgtggtgtgtgtggtgtatgacgtctctgaggaggccaccattgagaagattcgaactaagtggatcccactggtga

SEQ ID NO: 7683 - DNA, 237 bp, Artificial Sequence
  Synthetic polypeptide
gctggtgcggctgtgcgggcggggccggaagtgtggggacagcgcggggccgagaaccggaagtgcggggcgggcgcgggggcagagcgaaaggcttgaggaccagcccaggtggggaagacgtcgctgatcctgtccctggtgggcgaggagttccccgaggagaagccgagcagacggacgaggagctgcgggaggagatccacaagattcgaactaagtggatcccactggtga

SEQ ID NO: 7684 - DNA, 703 bp, Artificial Sequence
  Synthetic polypeptide
gctggtgcggctgtgcgggcggggccggaagtgtggggacagcgcggggccgagaaccggaagtgcggggcgggcgcgggggcagagcgaaaggcttgaggaccagcccaggtggggaagacgtcgctgatcctgtccctggtgggcgaggagttccccgaggaggtccctccccgcgcggaggagatcaccatccccgcggacgtcaccccggagaaggtgcccacccacatcgtggactactcagaagccgagcagacggacgaggagctgcgggaggagatccacaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtga

SEQ ID NO: 7685 - DNA, 1983 bp, Artificial Sequence
  Synthetic polypeptide
cccagcaacctctctgaccacgttccctgcccctctttttgctttttgctaagctgccagccactgacctcctgactgctcctctgacatcccccaggtgccctcgctaaaatttcacctctttcatcgccctgctcctcacctctccaagggactcctgccagcagcctggtcagcaaaatttctgcagtgcagtttccagaatctgctgacacaactgccaaacaaagcctaggttctcacagggccttaacttacactcagagtgccccagacctatcccctcaaatcctgactccacctgttatatgtagcagctgtggcagaccatattcccaagggaatcctgctgatgagcccctggagagaagtggggtagccactcggacaccaagtagaacagatgacactgctcaagttacctctgattatgaaaccaataacaacagtgacagcagtgacattgtacagaatgaagatgaaacagagtgcctgagagagcctctgaggaaagcatcggcttgcagcacctatgctcctgagaccatgatgtttctggacaaaccaattcttgctcccgaacctcttgtcatggataacctggactcaattatggagcagctaaatacttggaattttccaatttttgatttagtggaaaatataggaagaaaatgtggccgtattcttagtcaggtatcttacagactttttgaagacatgggcctctttgaagcttttaaaattccaattagggaatttatgaattattttcatgctttggagattggatatagggatattccttatcataacagaatccatgccactgatgttttacatgctgtttggtatcttactacacagcctattccaggcctctcaactgtgattaatgatcatggttcaaccagtgattcagattctgacagtggatttacacatggacatatgggatatgtattctcaaaaacgtataatgtgacagatgataaatacggatgtctgtctgggaatatccctgccttggagttgatggcgctgtatgtggctgcagccatgcacgattatgatcatccaggaaggactaatgctttcctggttgcaactagtgctcctcaggcggtgctatataacgatcgttcagttttggagaatcatcacgcagctgctgcatggaatcttttcatgtcccggccagagtataacttcttaattaaccttgaccatgtggaatttaagcatttccgtttccttgtcattgaagcaattttggccactgacctgaagaaacactttgacttcgtagccaaatttaatggcaaggtaaatgatgatgttggaatagattggaccaatgaaaatgatcgtctactggtttgtcaaatgtgtataaagttggctgatatcaatggtccagctaaatgtaaagaactccatcttcagtggacagatggtattgtcaatgaattttatgaacagggtgatgaagaggccagccttggattacccataagccccttcatggatcgttctgctcctcagctggccaaccttcaggaatccttcatctctcacattgtggggcctctgtgcaactcctatgattcagcaggactaatgcctggaaaatgggtggaagacagcgatgagtcaggagatactgatgacccagaagaagaggaggaagaagcaccagcaccaaatgaagaggaaacctgtgaaaataatgaatctccaaaaaagaagactttcaaaaggagaaaaatctactgccaaataactcagcacctcttacagaaccacaagatgtggaagaaagtcattgaagaggagcaacggttggcaggcatagaaaatcaatccctggaccagacccctcagtcgcactcttcagaacagatccaggctatcaaggaagaagaagaagagaaagggaaaccaagaggcgaggagataccaacccaaaagccagaccagtga

SEQ ID NO: 7686 - DNA, 1325 bp, Artificial Sequence
  Synthetic polypeptide
tatctagtctatgatccaaaaagtttcactcctaggtatttacccaagagaaatgagaatatatgtctgcaaaaagacctgtacagtgtgtccatagctgtcttattcatagtagcctcaaaatggacacaactcaagggcccgtcgaaagcagaggcaaatcatggtgtgtccctgcatcgtgaagagaaacaaagggctgatgcaacatgaggacgtctcaaagacaagttgcacttaagaagctatgctaagaaaacaaacacacagaagcctacatcattacatgtatagaatgttcaagaactgatgaaaccagtccgtggtcacaaaagccagaaagtggttgcttctggggaccagaagggaaaggggcataaaggaaccttttgaggtgaatagaagtttctgcatcttggtttggcacacatgccaaaactcaccagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagaaattgcaggtgctgcagtgtctgaaatttccgggcctttctcaacagaggatgtag

SEQ ID NO: 7687 - DNA, 1691 bp, Artificial Sequence
  Synthetic polypeptide
tatctagtctatgatccaaaaagtttcactcctaggtatttacccaagagaaatgagaatatatgtctgcaaaaagacctgtacagtgtgtccatagctgtcttattcatagtagcctcaaaatggacacaactcaagggcccgtcgaaagcagaggcaaatcatggtgtgtccctgcatcgtgaagagaaacaaagggctgatgcaacatgaggacgtctcaaagacaagttgcacttaagaagctatgctaagaaaacaaacacacagaagcctacatcattacatgtatagaatgttcaagaactgatgaaaccagtccgtggtcacaaaagccagaaagtggttgcttctggggaccagaagggaaaggggcataaaggaaccttttgaggtgaatagaagtttctgcatcttggtttggcacacatgccaaaactcaccagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatga

SEQ ID NO: 7688 - DNA, 1541 bp, Artificial Sequence
  Synthetic polypeptide
tatctagtctatgatccaaaaagtttcactcctaggtatttacccaagagaaatgagaatatatgtctgcaaaaagacctgtacagtgtgtccatagctgtcttattcatagtagcctcaaaatggacacaactcaagggcccgtcgaaagcagaggcaaatcatggtgtgtccctgcatcgtgaagagaaacaaagggctgatgcaacatgaggacgtctcaaagacaagttgcacttaagaagctatgctaagaaaacaaacacacagaagcctacatcattacatgtatagaatgttcaagaactgatgaaaccagtccgtggtcacaaaagccagaaagtggttgcttctggggaccagaagggaaaggggcataaaggaaccttttgaggtgaatagaagtttctgcatcttggtttggcacacatgccaaaactcaccagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatga

SEQ ID NO: 7689 - DNA, 567 bp, Artificial Sequence
  Synthetic polypeptide
gtttgatgtccaggctatccccttagctttgtgacttcaggtcatttcatgggcaacaacacagtgctggatgttttgcggcgtgaaggctatgaggtagaacacgcccctgctggacgacccatccacaaagggaagagtaaaaagacctccacacggcccactctgtccaccatctttgctccaaaagtccctaccctggaagtaccggcaccagaagccgtatcctcagggcactcaacgctgcctccccttgtgtcccggcctggaagtgccgacacgcccagtgaggccgaacagaggttccggaagaagcggaggcggtcacagcggaggccgcgactccggcaattcagcgatctgtgggtccgcctggaggagagtgacatagtcccgcaactccaggtccctgtcctggacaggcacatctccactgaactgcggctccctcgccgtgggcattcccaccacagccagatggtggccagcagtgcctgcctgtctctctggactcctgtgttctgggtgctggtgctggctttccaaacagagacacccctcctgtaa

SEQ ID NO: 7690 - DNA, 2564 bp, Artificial Sequence
  Synthetic polypeptide
tacaaggaggaactggtaccattcttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctaataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatactcatggataggaagaatcaatatcgtgaaaatggccatactgcccaagtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacgacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttga

SEQ ID NO: 7691 - DNA, 1448 bp, Artificial Sequence
  Synthetic polypeptide
tacaaggaggaactggtaccattcttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctaataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatactcatggataggaagaatcaatatcgtgaaaatggccatactgcccaagtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccatccccatataacaccaacagtgtacatgtttactgtcacttttgatatggtcttatccagtgtgaacagcaatttattcttatttttgctcatcaaaaaataa

SEQ ID NO: 7692 - DNA, 2417 bp, Artificial Sequence
  Synthetic polypeptide
tacaaggaggaactggtaccattcttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctaataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatactcatggataggaagaatcaatatcgtgaaaatggccatactgcccaagtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacgacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttga

SEQ ID NO: 7693 - DNA, 207 bp, Artificial Sequence
  Synthetic polypeptide
cgcccccgcccctgcccccccacccctgcacaggtcctggtgatcttgtcccagctagagggcaacgccggcttctctatcacccaccgcctggcacatcgcaaggcagcccaggccttcctcagtgactggacagcctccaaggggacccacagccccccactcacgccagaggtcgccggtctgcatgggccccgaccgctgtga

SEQ ID NO: 7694 - DNA, 268 bp, Artificial Sequence
  Synthetic polypeptide
cgcccccgcccctgcccccccacccctgcacaggtgccccctcccctaccccgctgcacccacacccaactcgtgcccccccacccctgcacaggtcctggtgatcttgtcccagctagagggcaacgccggcttctctatcacccaccgcctggcacatcgcaaggcagcccaggccttcctcagtgactggacagcctccaaggggacccacagccccccactcacgccagaggtcgccggtctgcatgggccccgaccgctgtga

SEQ ID NO: 7695 - DNA, 330 bp, Artificial Sequence; identical to SEQ ID NO: 6490
  Synthetic polypeptide

SEQ ID NO: 7696 - DNA, 1461 bp, Artificial Sequence
  Synthetic polypeptide
gtgaaaattactgagtcctgaacaggcaacttacattctaataccagctctgtctccatccagccgactgaatagtcgtgattaaatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaggaaaaccgaaggtccttgaacagaaggcatgctgagttggcacctcttgcagccatttaccaagaaattcaggagactgaacaagcaattgaagaattagaatcaatgtgtaaaagcctaaataaacaagatgaaaagcagttacaagaacttgcactggaagaaaggcaaaccattgatcaaaaaatcaacatgttgtacaatgagcttttccagagccttgtgccaaaggagaaatatgacaaaaatgatgttattttagaggtgacagctggaaggactactggaggtgacatctgccaacaatttacccgagaaatatttgacatgtaccagaattattcgtgctataaacactggcaatttgaacttctgaattatacaccagcagattatggtggactacatcatgcagccgcccgaatttccggtgacggtgtctataagcatttgaagtatgagggtgggattcaccgagttcagcgcatccccgaggtgggcctgtcctcaaggatgcagcgcattcacacaggaacgatgtcggttattgtccttcctcagccagatgaggtggatgtgaaattggaccccaaggatttgcgaatagatacatttcgagccaaaggagcaggagggcagcatgttaataaaactgatagtgccgtcagacttgtccacatccccacagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggctcagtctcattccacgggtggtagtcgtgaccctgcacattccacattcctatccttggattctgtgagatcacctggtattctcattatgacttcttctgttaggaatttttatgtggtgggaagggcctggatcagctaa

SEQ ID NO: 7697 - DNA, 80 bp, Artificial Sequence; identical to SEQ ID NO: 6364
  Synthetic polypeptide

SEQ ID NO: 7698 - DNA, 217 bp, Artificial Sequence; identical to SEQ ID NO: 6365
  Synthetic polypeptide

SEQ ID NO: 7699 - DNA, 584 bp, Artificial Sequence
  Synthetic polypeptide
gggggcctagtcgctgcggcatgcctgggacttgcctgccctcagcactgacacccctcagtcccaggcaaagtgggacaggccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagccactggacggatgtccaggtgaaggggacgtcgctgccccgagcactgcactgctgggacaggagcctccatgacagccacaaggccagcaagacccccctcaagggctgccccgtccacctggtggacagctgcccctggccccactgcaacccctcatgccccaccgtccgagaccagttcacggggcaagagatgaacgtggcccagttcctcatgcacatgggcttcgacatgcagacggtggcccagccgcagggactggagcccagtgagctgctggggatgctgagcaacggaagctag

SEQ ID NO: 7700 - DNA, 111 bp, Artificial Sequence
  Synthetic polypeptide
gggggcctagtcgctgcggcatgcctgggacttgcctgccctcagcactgacacccctcagtcccaggcaaagtgggacaggccctgtgttcgtggtgcagtggctgtttg

SEQ ID NO: 7701 - DNA, 404 bp, Artificial Sequence
  Synthetic polypeptide
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaataggtgtgtatg

SEQ ID NO: 7702 - DNA, 336 bp, Artificial Sequence
  Synthetic polypeptide
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacaca

SEQ ID NO: 7703 - DNA, 3325 bp, Artificial Sequence
  Synthetic polypeptide
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtga

SEQ ID NO: 7704 - DNA, 169 bp, Artificial Sequence
  Synthetic polypeptide
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctctta

SEQ ID NO: 7705 - DNA, 169 bp, Artificial Sequence
  Synthetic polypeptide
ggcgccggcgccggcggccgcggcgggcgcaatggcggcggccgcggcggagcagcaacagttctacctgctcctgggaaacctgctcagccccgacaatgtggtccggaaacaggcagagacagatatgtttgaaaagtttgaaacctgtgtagcactgcataaatag

SEQ ID NO: 7706 - DNA, 241 bp, Artificial Sequence
  Synthetic polypeptide
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttg

SEQ ID NO: 7707 - DNA, 273 bp, Artificial Sequence
  Synthetic polypeptide
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcact

SEQ ID NO: 7708 - DNA, 329 bp, Artificial Sequence
  Synthetic polypeptide
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatgg

SEQ ID NO: 7709 - DNA, 203 bp, Artificial Sequence
  Synthetic polypeptide
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagagg

SEQ ID NO: 7710 - DNA, 271 bp, Artificial Sequence
  Synthetic polypeptide
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagca

SEQ ID NO: 7711 - DNA, 297 bp, Artificial Sequence
  Synthetic polypeptide
ggcgccggcgccggcggccgcggcgggcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccat

SEQ ID NO: 7712 - DNA, 127 bp, Artificial Sequence
  Synthetic polypeptide
ggcgccggcgccggcggccgcggcgggcgcaatggcggcggccgcggcggagcagcaacagttctacctgctcctgggaaacctgctcagccccgacaatgtggtccggaaacaggcagaggtaacc

SEQ ID NO: 7713 - DNA, 333 bp, Artificial Sequence; identical to SEQ ID NO: 6583
  Synthetic polypeptide

SEQ ID NO: 7714 - DNA, 342 bp, Artificial Sequence; identical to SEQ ID NO: 7076
  Synthetic polypeptide

SEQ ID NO: 7715 - DNA, 1516 bp, Artificial Sequence; identical to SEQ ID NO: 7077
  Synthetic polypeptide

SEQ ID NO: 7716 - DNA, 1444 bp, Artificial Sequence; identical to SEQ ID NO: 7078
  Synthetic polypeptide

SEQ ID NO: 7717 - DNA, 1312 bp, Artificial Sequence; identical to SEQ ID NO: 7079
  Synthetic polypeptide

SEQ ID NO: 7718 - DNA, 1775 bp, Artificial Sequence; identical to SEQ ID NO: 568
  Synthetic polypeptide

SEQ ID NO: 7719 - DNA, 807 bp, Artificial Sequence; identical to SEQ ID NO: 7401
  Synthetic polypeptide

SEQ ID NO: 7720 - DNA, 453 bp, Artificial Sequence; identical to SEQ ID NO: 7402
  Synthetic polypeptide

SEQ ID NO: 7721 - DNA, 1609 bp, Artificial Sequence
  Synthetic polypeptide
tagtgtccttaatatataaagaattgctacaagtcaaaaaaggtaaaggtcaacaacccaaaacaaatatttcatagaaaaatacagaaatctcttgaacagatgaaaacttcagcaacctcacttacggtaaaaaaaaaatgcaaaataaaactacaatatacaattttcactagtaataatgggaaagctcagagtttgcaaatgtatggtactggaaagaatgtagggaggcaggcattgtcacgcattgatgccaaaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctag

SEQ ID NO: 7722 - DNA, 1525 bp, Artificial Sequence
  Synthetic polypeptide
tagtgtccttaatatataaagaattgctacaagtcaaaaaaggtaaaggtcaacaacccaaaacaaatatttcatagaaaaatacagaaatctcttgaacagatgaaaacttcagcaacctcacttacggtaaaaaaaaaatgcaaaataaaactacaatatacaattttcactagtaataatgggaaagctcagagtttgcaaatgtatggtactggaaagaatgtagggaggcaggcattgtcacgcattgatgccaaaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctag

SEQ ID NO: 7723 - DNA, 436 bp, Artificial Sequence
  Synthetic polypeptide
tagtgtccttaatatataaagaattgctacaagtcaaaaaaggtaaaggtcaacaacccaaaacaaatatttcatagaaaaatacagaaatctcttgaacagatgaaaacttcagcaacctcacttacggtaaaaaaaaaatgcaaaataaaactacaatatacaattttcactagtaataatgggaaagctcagagtttgcaaatgtatggtactggaaagaatgtagggaggcaggcattgtcacgcattgatgccaaaggaaccagttgctgtttcttcccatgtcgtgaccatctccagccttcttcctgccactgcctacaattgtagtgtcaccagctttagccatgacagccccagtgtccctacgttcatagccgtctcaacaatggggagtgtggagctggtacatttgtcaattttgcatccttag

SEQ ID NO: 7724 - DNA, 1022 bp, Artificial Sequence; identical to SEQ ID NO: 590
  Synthetic polypeptide

SEQ ID NO: 7725 - DNA, 347 bp, Artificial Sequence; identical to SEQ ID NO: 591
  Synthetic polypeptide

SEQ ID NO: 7726 - DNA, 1109 bp, Artificial Sequence; identical to SEQ ID NO: 592
  Synthetic polypeptide

SEQ ID NO: 7727 - DNA, 85 bp, Artificial Sequence; identical to SEQ ID NO: 601
  Synthetic polypeptide

SEQ ID NO: 7728 - DNA, 269 bp, Artificial Sequence; identical to SEQ ID NO: 600
  Synthetic polypeptide

SEQ ID NO: 7729 - DNA, 1508 bp, Artificial Sequence
  Synthetic polypeptide
tagctatgtggatcctgggcagattgtccatgttgctgggcctccgttgcttcactgtatgacgtctgcctctcagggatgcaggaagattcaattagatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggactcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccagtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactga

SEQ ID NO: 7730 - DNA, 603 bp, Artificial Sequence
  Synthetic polypeptide
tagctatgtggatcctgggcagattgtccatgttgctgggcctccgttgcttcactgtatgacgtctgcctctcagggatgcaggaagattcaattagatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaag

SEQ ID NO: 7731 - DNA, 909 bp, Artificial Sequence
  Synthetic polypeptide
tagctatgtggatcctgggcagattgtccatgttgctgggcctccgttgcttcactgtatgacgtctgcctctcagggatgcaggaagattcaattagatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctg

SEQ ID NO: 7732 - DNA, 1114 bp, Artificial Sequence
  Synthetic polypeptide
agggaacaggaaactgagagtcaggaaaggttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttag

SEQ ID NO: 7733 - DNA, 363 bp, Artificial Sequence
  Synthetic polypeptide
agggaacaggaaactgagagtcaggaaaggttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaa

SEQ ID NO: 7734 - DNA, 455 bp, Artificial Sequence
  Synthetic polypeptide
tttggtgccgtgactcggatcgggggacctcccttgggagatcaatcccccatcctcctgctctttgctccatgagaaaaatccacctatgaccttaggtcctcagaccgaccagcccaagaaacatctcaccaatttcaaatccgatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatga

SEQ ID NO: 7735 - DNA, 2465 bp, Artificial Sequence
  Synthetic polypeptide
ggcagggtgcggtggctcacacctgtaatcccagcactttgggaggccaaggcgggcggatcacgaggtcaggagatcgagaccatcctggctaacacggtgaaatcccggctctactaaaaatacaaaaagtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagccacacgtctgtcaccatggaagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggagtctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtaccctggaggtggattccttcggctattttgtcagcaaagccaaaaccagggtgttccgggacacagcggagcccaagtgggatgaggagtttgagatcgagctggagggctcccagtccctgaggatcctgtgctatgagaagtgctatgacaagaccaaggtcaacaaggacaacaatgagatcgtggacaagatcatgggcaaaggacagatccagctggacccacaaaccgtggagaccaagaactggcacacggacgtgattgagatgaacgggatcaaagtggaattttccatgaaattcaccagccgagatatgagcctgaagaggaccccgtccaaaaagcagaccggcgtcttcggtgtgaagatcagcgtggtgacgaagcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccaataacaaggacatcctgctgatgctgagtgacatggacatcaacgccatcgccgggacgctcaagctgtacttccgggaactgcccgagccgctcctcacggaccgactctacccagccttcatggagggcatcgccctgtcagaccctgctgccaaggaaaactgcatgatgcacctgctccgctccctgcccgaccccaacctcatcaccttcctcttcctgctggaacacttgaaaagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtccaggtcctcctctactacctgcagcacccccccatttccttcgcagaactcaagcggaacacactgtacttctccaccgacgtgtag

SEQ ID NO: 7736 - DNA, 412 bp, Artificial Sequence
  Synthetic polypeptide
ggcagggtgcggtggctcacacctgtaatcccagcactttgggaggccaaggcgggcggatcacgaggtcaggagatcgagaccatcctggctaacacggtgaaatcccggctctactaaaaatacaaaaagtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaa

SEQ ID NO: 7737 - DNA, 289 bp, Artificial Sequence
  Synthetic polypeptide
ggcagggtgcggtggctcacacctgtaatcccagcactttgggaggccaaggcgggcggatcacgaggtcaggagatcgagaccatcctggctaacacggtgaaatcccggctctactaaaaatacaaaaagtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcaccatccagca

SEQ ID NO: 7738 - DNA, 282 bp, Artificial Sequence
  Synthetic polypeptide
ggcagggtgcggtggctcacacctgtaatcccagcactttgggaggccaaggcgggcggatcacgaggtcaggagatcgagaccatcctggctaacacggtgaaatcccggctctactaaaaatacaaaaagtggaagcagggaaaggcctggagatgaggaagctggttctctcggggttcttggccagcgaagagatctacattaaccagctggaagccctgttgctgcccatgaaacccctgaaggccaccgccaccacctcccagcccgtgctcacca

SEQ ID NO: 7739 - DNA, 1637 bp, Artificial Sequence
  Synthetic polypeptide
tttcttggttccctgactgggaagcgaggtgattggtggatggtggaggcagctccttaggcagcttaagcctgtcctgtggaacatccctgtgggagactgtgaccagaccaagcgacacggatcctgagagcgctcccgggtaggcatttgccccggtgggacacctcaccacagcagtgtgtggcaggcccccgtggagaatcaacgcagtggctgaacaccgggaaggaatgggcacttggagtctggacatctaaaacttgtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtcccattaagcaactaccagattttaaacagatacgcagtaacatgtgttggcttcgtgattaa

SEQ ID NO: 7740 - DNA, 1640 bp, Artificial Sequence
  Synthetic polypeptide
tttcttggttccctgactgggaagcgaggtgattggtggatggtggaggcagctccttaggcagcttaagcctgtcctgtggaacatccctgtgggagactgtgaccagaccaagcgacacggatcctgagagcgctcccgggtaggcatttgccccggtgggacacctcaccacagcagtgtgtggcaggcccccgtggagaatcaacgcagtggctgaacaccgggaaggaatgggcacttggagtctggacatctaaaacttgtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtaagcctggcttcttttcttctatgcaaaaagttggccaagtacttttaattaactcttctttttaa

SEQ ID NO: 7741 - DNA, 776 bp, Artificial Sequence
  Synthetic polypeptide
tttcttggttccctgactgggaagcgaggtgattggtggatggtggaggcagctccttaggcagcttaagcctgtcctgtggaacatccctgtgggagactgtgaccagaccaagcgacacggatcctgagagcgctcccgggtaggcatttgccccggtgggacacctcaccacagcagtgtgtggcaggcccccgtggagaatcaacgcagtggctgaacaccgggaaggaatgggcacttggagtctggacatctaaaacttgtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagcttatcaaaatactgcacttggacggacaattttgggaccaactgaaaatatcaaatctataagtcgtaaggacttagtggattatataaccacacattataaggggccaagaatagtgcttgctgctgctggagattcgtgtgagggatga

SEQ ID NO: 7742 - DNA, 536 bp, Artificial Sequence
  Synthetic polypeptide
tttcttggttccctgactgggaagcgaggtgattggtggatggtggaggcagctccttaggcagcttaagcctgtcctgtggaacatccctgtgggagactgtgaccagaccaagcgacacggatcctgagagcgctcccgggtaggcatttgccccggtgggacacctcaccacagcagtgtgtggcaggcccccgtggagaatcaacgcagtggctgaacaccgggaaggaatgggcacttggagtctggacatctaaaacttgtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaaggcaaggcaccaagaagagatcccagttagatctggaacttga

SEQ ID NO: 7743 - DNA, 527 bp, Artificial Sequence
  Synthetic polypeptide
tttcttggttccctgactgggaagcgaggtgattggtggatggtggaggcagctccttaggcagcttaagcctgtcctgtggaacatccctgtgggagactgtgaccagaccaagcgacacggatcctgagagcgctcccgggtaggcatttgccccggtgggacacctcaccacagcagtgtgtggcaggcccccgtggagaatcaacgcagtggctgaacaccgggaaggaatgggcacttggagtctggacatctaaaacttgtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaaggcaaaagagatcccagttagatctggaacttga

SEQ ID NO: 7744 - DNA, 295 bp, Artificial Sequence
  Synthetic polypeptide
gcatgggctttggaatcagagaagctggcttgaatttcaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctac

SEQ ID NO: 7745 - DNA, 286 bp, Artificial Sequence
  Synthetic polypeptide
gcatgggctttggaatcagagaagctggcttgaatttcaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagt

SEQ ID NO: 7746 - DNA, 3541 bp, Artificial Sequence
  Synthetic polypeptide
gcatgggctttggaatcagagaagctggcttgaatttcaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagcttttgaaatcctgtcatgcagtgtcccaaacgcaaggcgaaggagatgcagcagatggtgaaattggaagccgagatggaccgcagaccagcaacagtagtatgaaactccaaaatgcaaactga

SEQ ID NO: 7747 - DNA, 3520 bp, Artificial Sequence
  Synthetic polypeptide
gcatgggctttggaatcagagaagctggcttgaatttcaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaaggcttcagatgaccttgaacatgaaaacaacaaaaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatga

SEQ ID NO: 7748 - DNA, 200 bp, Artificial Sequence
  Synthetic polypeptide
gcatgggctttggaatcagagaagctggcttgaatttcaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctg

SEQ ID NO: 7749 - DNA, 135 bp, Artificial Sequence
  Synthetic polypeptide
gcatgggctttggaatcagagaagctggcttgaatttcaggaatcctttgtgtttgaacccaactgcctcttcaaagtggatgagtttggcttctttctgacatggagaagtgaaggcaaggaaggacaggtgct

SEQ ID NO: 7750 - DNA, 3484 bp, Artificial Sequence
  Synthetic polypeptide
gcatgggctttggaatcagagaagctggcttgaatttcaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatga

SEQ ID NO: 7751 - DNA, 1392 bp, Artificial Sequence; identical to SEQ ID NO: 6782
  Synthetic polypeptide

SEQ ID NO: 7752 - DNA, 933 bp, Artificial Sequence; identical to SEQ ID NO: 6783
  Synthetic polypeptide

SEQ ID NO: 7753 - DNA, 981 bp, Artificial Sequence; identical to SEQ ID NO: 6784
  Synthetic polypeptide

SEQ ID NO: 7754 - DNA, 1443 bp, Artificial Sequence; identical to SEQ ID NO: 6760
  Synthetic polypeptide

SEQ ID NO: 7755 - DNA, 984 bp, Artificial Sequence; identical to SEQ ID NO: 6761
  Synthetic polypeptide

SEQ ID NO: 7756 - DNA, 1032 bp, Artificial Sequence; identical to SEQ ID NO: 6762
  Synthetic polypeptide

SEQ ID NO: 7757 - DNA, 311 bp, Artificial Sequence
  Synthetic polypeptide
agaggtgattaggctatgagggctctgctttcatgaatggattaatgccattacggcagtgagttcattataaaaggacaagtttggcccccttctctctctttcttgctctcttttggcccttttgccttctgccatgggatgacacagcacaaaaaccctcaccagatgctgaccccttgatactggacttcccagcctccagaactataatgatggttgcagggcccctcttcaatggaggcattgccagccttctggccatgaaggagaaagtgatttcaactaacccaggaaactcttacctctaa

SEQ ID NO: 7758 - DNA, 1346 bp, Artificial Sequence
  Synthetic polypeptide
ggacgggggcgcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaa

SEQ ID NO: 7759 - DNA, 696 bp, Artificial Sequence
  Synthetic polypeptide
tggaagtgagtacctctatttttctagagatggtttaattatttccctctcttttctcatttttccggcaccccgtttcctacttagtccttcagaaatgtatatataacctttcacctcccccatcaccagacactccctaaggggcaagttcttctagataggtgctccatgacgggtctctcctcaagagttgacagttgatcagcagaccatagcatacctgccatggacctttcatctttaggggattgccttagaacttccatcctgggccacctcggaactcacacactttcggagggtgcgtcagaagcatatccagcggagccacccaagccctccatcaccagcaacaacttcaatccggtggagaacaaagatattgtggttttaacctgtcaacctgagactcagaacacaacctacctgtggtgggtaaacaatcagagcctcctggtcagtcccaggctgctgctctccactgacaacaggaccctcgttctactcagcgccacaaagaatgacataggaccctatgaatgtgaaatacagaacccagtgggtgccagccgcagtgacccagtcaccctgaatgtccgctatgagtcagtacaagcaagttcacctgacctctcagctgggaccgctgtcagcatcatgattggagtactggctgggatggctctgatatag

SEQ ID NO: 7760 - DNA, 1102 bp, Artificial Sequence
  Synthetic polypeptide
tgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 7761 - DNA, 1030 bp, Artificial Sequence
  Synthetic polypeptide
tgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactga

SEQ ID NO: 7762 - DNA, 898 bp, Artificial Sequence
  Synthetic polypeptide
tgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagtgggggaaatag

SEQ ID NO: 7763 - DNA, 100 bp, Artificial Sequence; identical to SEQ ID NO: 6584
  Synthetic polypeptide

SEQ ID NO: 7764 - DNA, 417 bp, Artificial Sequence
  Synthetic polypeptide
tggaagtgagtacctctatttttctagagatggtttaattatttccctctcttttctcatttttccggcaccccgtttcctacttagtccttcagaaatgtatatataacctttcacctcccccatcaccagacactccctaaggggcaagttcttctagataggtgctccatgacgggtctctcctcaagagttgacagttgatcagcagaccatagcatacctgccatggacctttcatctttaggggattgccttagaacttccatcctgggccacctcggaactcacacactttcggagggtgcgtcagaagcatatccagatgagtcagtacaagcaagttcacctgacctctcagctgggaccgctgtcagcatcatgattggagtactggctgggatggctctgatatag

SEQ ID NO: 7765 - DNA, 1059 bp, Artificial Sequence
  Synthetic polypeptide
tggaagtgagtacctctatttttctagagatggtttaattatttccctctcttttctcatttttccggcaccccgtttcctacttagtccttcagaaatgtatatataacctttcacctcccccatcaccagacactccctaaggggcaagttcttctagataggtgctccatgacgggtctctcctcaagagttgacagttgatcagcagaccatagcatacctgccatggacctttcatctttaggggattgccttagaacttccatcctgggccacctcggaactcacacactttcggagggtgcgtcagaagcatatccagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacggtcgagagacaatataccccaatggaaccctgctgatccagaacgtcacccacaatgacgcaggattctataccctacacgttataaaagaaaatcttgtgaatgaagaagtaaccagacaattctacgtattctcggagccacccaagccctccatcaccagcaacaacttcaatccggtggagaacaaagatattgtggttttaacctgtcaacctgagactcagaacacaacctacctgtggtgggtaaacaatcagagcctcctggtcagtcccaggctgctgctctccactgacaacaggaccctcgttctactcagcgccacaaagaatgacataggaccctatgaatgtgaaatacagaacccagtgggtgccagccgcagtgacccagtcaccctgaatgtccgctatgagtcagtacaagcaagttcacctgacctctcagctgggaccgctgtcagcatcatgattggagtactggctgggatggctctgatatag

SEQ ID NO: 7766 - DNA, 780 bp, Artificial Sequence
  Synthetic polypeptide
tggaagtgagtacctctatttttctagagatggtttaattatttccctctcttttctcatttttccggcaccccgtttcctacttagtccttcagaaatgtatatataacctttcacctcccccatcaccagacactccctaaggggcaagttcttctagataggtgctccatgacgggtctctcctcaagagttgacagttgatcagcagaccatagcatacctgccatggacctttcatctttaggggattgccttagaacttccatcctgggccacctcggaactcacacactttcggagggtgcgtcagaagcatatccagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacggtcgagagacaatataccccaatggaaccctgctgatccagaacgtcacccacaatgacgcaggattctataccctacacgttataaaagaaaatcttgtgaatgaagaagtaaccagacaattctacgtattctatgagtcagtacaagcaagttcacctgacctctcagctgggaccgctgtcagcatcatgattggagtactggctgggatggctctgatatag

SEQ ID NO: 7767 - DNA, 164 bp, Artificial Sequence; identical to SEQ ID NO: 831
  Synthetic polypeptide

SEQ ID NO: 7768 - DNA, 193 bp, Artificial Sequence; identical to SEQ ID NO: 834
  Synthetic polypeptide

SEQ ID NO: 7769 - DNA, 732 bp, Artificial Sequence
  Synthetic polypeptide
ggctggctgcagtggctcacacttttgatgccaccactttgggaggctgaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctga

SEQ ID NO: 7770 - DNA, 879 bp, Artificial Sequence
  Synthetic polypeptide
ggctggctgcagtggctcacacttttgatgccaccactttgggaggctgaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctga

SEQ ID NO: 7771 - DNA, 99 bp, Artificial Sequence
  Synthetic polypeptide
ggctggctgcagtggctcacacttttgatgccaccactttgggaggctgaggcctatgtgatccggggtgataccctgcggatggagctgccccagagg

SEQ ID NO: 7772 - DNA, 646 bp, Artificial Sequence
  Synthetic polypeptide
cagtgtggggcagtggttatgagcagggactctggagccagagtgcctgggttctcatcctgcttctgcagcgtggtagctggatggccttggacaagtcgcctgacctccccgtgcctcagcagtaaatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatga

SEQ ID NO: 7773 - DNA, 304 bp, Artificial Sequence
  Synthetic polypeptide
cagtgtggggcagtggttatgagcagggactctggagccagagtgcctgggttctcatcctgcttctgcagcgtggtagctggatggccttggacaagtcgcctgacctccccgtgcctcagcagtaaatgctgtgttctttgcaacctacctgaccctggcttgctgttctggacccaggaggcatttcccctggaacctgattctcctgaccgtctttaccctgtccatggcctacctcactgggatgctgtccagttcgacttcacctcctgccagggcgtgctcttcgtgcttctcatga

SEQ ID NO: 7774 - DNA, 619 bp, Artificial Sequence
  Synthetic polypeptide
cagtgtggggcagtggttatgagcagggactctggagccagagtgcctgggttctcatcctgcttctgcagcgtggtagctggatggccttggacaagtcgcctgacctccccgtgcctcagcagtaaatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctg

SEQ ID NO: 7775 - DNA, 523 bp, Artificial Sequence
  Synthetic polypeptide
cagtgtggggcagtggttatgagcagggactctggagccagagtgcctgggttctcatcctgcttctgcagcgtggtagctggatggccttggacaagtcgcctgacctccccgtgcctcagcagtaaatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatttcctggcacttgacacccagttgctgatgggtaaccgacgccactcgctgagccctgaggagtatatttttggagccctc

SEQ ID NO: 7776 - DNA, 441 bp, Artificial Sequence
  Synthetic polypeptide
cagtgtggggcagtggttatgagcagggactctggagccagagtgcctgggttctcatcctgcttctgcagcgtggtagctggatggccttggacaagtcgcctgacctccccgtgcctcagcagtaaatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaata

SEQ ID NO: 7777 - DNA, 167 bp, Artificial Sequence
  Synthetic polypeptide
cagtgtggggcagtggttatgagcagggactctggagccagagtgcctgggttctcatcctgcttctgcagcgtggtagctggatggccttggacaagtcgcctgacctccccgtgcctcagcagtaaatgctgtgttctttgcaacctacctgaccctggcttgct

SEQ ID NO: 7778 - DNA, 1238 bp, Artificial Sequence
  Synthetic polypeptide
agcagatactgttagtgccctacccagtcctcttgcttttaagtgcacacagactgacttctgacttctaactttgtacatctgtactttgcctgagggcttttctctctgtgacacccatagtagatttgaaatgcctggaattaatgctctttcttttcccccatccacttttctaagcaggcttcaagaaagaactcatcagagataatcatacggcagcttccccaccctttgggtgggttaacactctggtgcagtgtggtgactttcctcatctgttagtgtacggaccatcaggtgctggaaaaaagacaagaattatgtgtattctacgtgaactttatggtgttggagtggaaaaattgagaattgaacatcagaccatcacaactccatctaaaaaaaaaattgaaattagcaccattgcaagtaactaccaccttgaagttaatcctagtgatgctggaaatagtgaccgagtagtcattcaggagatgttgaaaacagtggcacaatcacaacaacttgaaacaaactctcaaagggattttaaagtggtattattgacagaagttgacaaactcaccaaagatgctcagcatgccttgcgaagaaccatggaaaaatatatgtctacctgcagattgatcttgtgctgcaattctacatctaaagtgatcccacctattcgtagtaggtgcttggcggttcgtgtgcctgctcccagcattgaagatatttgccacgtgttatctactgtgtgtaagaaggaaggtctgaatcttccttcacaactggctcatagacttgcagagaagtcttgtagaaatctcagaaaagccctgcttatgtgtgaagcctgcagagtgcaacaatatccttttactgcagatcaagaaatccctgagacagattgggaggtgtatctgagggagactgcaaatgctattgtcagtcagcaaactccacaaaggctccttgaagttcgtggaaggctgtatgagcttctaactcattgtattcctcctgagataataatgaagggccttctctcagaactgttacataattgtgatggacaactgaaaggggaggtggcacaaatggcagcttactatgagcatcgtctacagctgggtagcaaagccatttatcacttggaagcgtttgtggccaaattcatggcactttataagaagttcatggaggatggattggaaggcatgatgttctga

SEQ ID NO: 7779 - DNA, 1085 bp, Artificial Sequence
  Synthetic polypeptide
agcagatactgttagtgccctacccagtcctcttgcttttaagtgcacacagactgacttctgacttctaactttgtacatctgtactttgcctgagggcttttctctctgtgacacccatagtagatttgaaatgcctggaattaatgctctttcttttcccccatccacttttctaagcaggcttcaagaaagaactcatcagagataatcatacggcagcttccccaccctttgggtgggttaacactctggtgcagtgtggtgactttcctcatctgttagtgtacggaccatcaggtgctggaaaaaagacaagaattatgtgtattctacgtgaactttatggtgttggagtggaaaaattgagaattgaacatcagaccatcacaactccatctaaaaaaaaaattgaaattagcaccattgcaagtaactaccaccttgaagttaatcctagtgatgctggaaatagtgaccgagtagtcattcaggagatgttgaaaacagtggcacaatcacaacaacttgaaacaaactctcaaagggattttaaagtggtattattgacagaagttgacaaactcaccaaagatgctcagcatgccttgcgaagaaccatggaaaaatatatgtctacctgcagattgatcttgtgctgcaattctacatctaaagtgatcccacctattcgtagtaggtgcttggcggttcgtgtgcctgctcccagcattgaagatatttgccacgtgttatctactgtgtgtaagaaggaaggtctgaatcttccttcacaactggctcatagacttgcagagaagtcttgtagaaatctcagaaaagccctgcttatgtgtgaagcctgcagagtgcaacaatatccttttactgcagatcaagaaatccctgagacagattgggaggtgtatctgagggagactgcaaatgctattgtcagtcagcaaactccacaaaggctccttgaagttcgtggaaggctgtatgagcttctaactcattgtattcctcctgagataataatgaaggcatgtaaggaggaatcaagaagctgtgacatattctga

SEQ ID NO: 7780 - DNA, 829 bp, Artificial Sequence; identical to SEQ ID NO: 624
  Synthetic polypeptide

SEQ ID NO: 7781 - DNA, 2534 bp, Artificial Sequence; identical to SEQ ID NO: 586
  Synthetic polypeptide

SEQ ID NO: 7782 - DNA, 145 bp, Artificial Sequence
  Synthetic polypeptide
ggaaataggatgatcttttcagtttcaaactataagagaaacaatggatcagagcagaagcaatcatgtatacaggcagaatggagcccagtcccttccagctggctttattcagccccacgtgtccaagcattgtctgggatag

SEQ ID NO: 7783 - DNA, 846 bp, Artificial Sequence; identical to SEQ ID NO: 7174
  Synthetic polypeptide

SEQ ID NO: 7784 - DNA, 506 bp, Artificial Sequence; identical to SEQ ID NO: 7175
  Synthetic polypeptide

SEQ ID NO: 7785 - DNA, 672 bp, Artificial Sequence; identical to SEQ ID NO: 7176
  Synthetic polypeptide

SEQ ID NO: 7786 - DNA, 708 bp, Artificial Sequence; identical to SEQ ID NO: 7177
  Synthetic polypeptide

SEQ ID NO: 7787 - DNA, 561 bp, Artificial Sequence
  Synthetic polypeptide
gccatgttgatttctcattagccccagtctcgtgaatgcctcctgattctgattttatttactgtttttagtgtaagaacaaagcagccttgatcttaccacacaaattataggcagtgacgcacatagcattcccacctgttctggaggatgcctttaattgcctctgtagagcacgtacaccctttccctgtggcatataagctctgggtctggccagtaacagagtgggttatacctgtcttgcagccatccgagatcacgcttctgtcttacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatga

SEQ ID NO: 7788 - DNA, 609 bp, Artificial Sequence
  Synthetic polypeptide
gccatgttgatttctcattagccccagtctcgtgaatgcctcctgattctgattttatttactgtttttagtgtaagaacaaagcagccttgatcttaccacacaaattataggcagtgacgcacatagcattcccacctgttctggaggatgcctttaattgcctctgtagagcacgtacaccctttccctgtggcatataagctctgggtctggccagtaacagagtgggttatacctgtcttgcagccatccgagatcacgcttctgtcttacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggcaacctcgagtctgtctgtagagatctgcctattctggacatttcaggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatga

SEQ ID NO: 7789 - DNA, 720 bp, Artificial Sequence
  Synthetic polypeptide
atccccaccagaggaaattccaaagagagtgtacttcagacaaaacagaaatgttctgaggcacaagaagaagtaaagagcaaaggaagtaatgcggccatcatggtctcttgctgtgctatttcttggtcaactgttgattatcaagtagctttaagaaaatccttgcctgacaaaaagcttcttaatggattatgtcccaaaatcacatatctcttttacaagttgtttacattattatcgtggatgctgagtgttgtacttctactattcttaaatgttaagattgctttatttctgttgttatttctttggttgttaggtataatatgggcatttaaaaacaacacccagttttgtacttgtataagtatggaattcttatataggattgttgttggattcattcttatctttacattttttaatattaagggacagaataccaagtgtccaatgtcttgttattatattgttagggtactgggcactttggggatattgactgtattctgggtttgccccctcactatttttaatccagactattttatacctatcagtataactatagttcttactcttcttcttggaattctttttcttattgtttattatgggagttttcacccaaacagaagtgcagaaacaaaatgtgatgaaattgatggaaaaccagttctaagagaatgtagaatgagatatttcctaatggaataa

SEQ ID NO: 7790 - DNA, 1490 bp, Artificial Sequence; identical to SEQ ID NO: 7414
  Synthetic polypeptide

SEQ ID NO: 7791 - DNA, 1031 bp, Artificial Sequence; identical to SEQ ID NO: 7415
  Synthetic polypeptide

SEQ ID NO: 7792 - DNA, 1079 bp, Artificial Sequence; identical to SEQ ID NO: 7416
  Synthetic polypeptide

SEQ ID NO: 7793 - DNA, 1349 bp, Artificial Sequence; identical to SEQ ID NO: 7130
  Synthetic polypeptide

SEQ ID NO: 7794 - DNA, 740 bp, Artificial Sequence
  Synthetic polypeptide
gaccacttctcaattttcaattctgcttccaagaagtaaccatttttcaattctctgcaatttttatcaggtaaacttctttcttcatgcaccctgccaccctacatcagatccaacacagtagccagagtgatttttaaaatgaatttgatgaatcttcacccaaacaacctacaaatccttatgcatcatctaaagcagctgctgaatgttttgtacagtcttactgggaacaatataagtttccagttgtcatcacaagaagcagtaatgtttatggaccacatcaatatccagaaaaggttattccaaaatttatatctttgctacagcacaacaggaaatgttgcattcatgggtcagggcttcaaacaagaaacttcctttatgctactgatgttgtagaagcatttctcactgtcctcaaaaaagggaaaccaggtgaaatttataacatcggaaccaattttgaaatgtcagttgtccagcttgccaaagaactaatacaactgatcaaagagaccaattcagagtctgaaatggaaaattgggttgattatgttaatgatagacccaccaatgacatgagatacccaatgaagtcagaaaaaatacatggcttaggatggagacctaaagtgccttggaaagaaggaataaagaaaacaattgaatggtacagagagaattttcacaactggaagaatgtggaaaaggcattagaaccctttccggtataa

SEQ ID NO: 7795 - DNA, 411 bp, Artificial Sequence; identical to SEQ ID NO: 6630
  Synthetic polypeptide

SEQ ID NO: 7796 - DNA, 1093 bp, Artificial Sequence
  Synthetic polypeptide
gagtgtgggcgcgaggcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcgctgggggccagcggaagcagcggccacgaactctctgcgctaggcggtgagggtggcctgcagagcctgctgggaaacatgagccacagccagctcatgcagctcatcggaccagccggccttggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactga

SEQ ID NO: 7797 - DNA, 427 bp, Artificial Sequence; identical to SEQ ID NO: 573
  Synthetic polypeptide

SEQ ID NO: 7798 - DNA, 1327 bp, Artificial Sequence; identical to SEQ ID NO: 6801
  Synthetic polypeptide

SEQ ID NO: 7799 - DNA, 812 bp, Artificial Sequence; identical to SEQ ID NO: 693
  Synthetic polypeptide

SEQ ID NO: 7800 - DNA, 752 bp, Artificial Sequence; identical to SEQ ID NO: 694
  Synthetic polypeptide

SEQ ID NO: 7801 - DNA, 2304 bp, Artificial Sequence
  Synthetic polypeptide
tttccctgaggactcatattctcctttcctgcttcatttttctttacagaattattgacgtggcatgctgtaatgtttcagttttgtagttgtctatctccccacagtggaatatgagttctgtgaaagcaaggatttttgtctcctttgttcaaagctgtatccctgagaatggcacctaagtatacttactccttgggcatgtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtga

SEQ ID NO: 7802 - DNA, 1224 bp, Artificial Sequence; identical to SEQ ID NO: 6690
  Synthetic polypeptide

SEQ ID NO: 7803 - DNA, 842 bp, Artificial Sequence; identical to SEQ ID NO: 6534
  Synthetic polypeptide

SEQ ID NO: 7804 - DNA, 395 bp, Artificial Sequence
  Synthetic polypeptide
atgcagcaaaaaacagcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctga

SEQ ID NO: 7805 - DNA, 173 bp, Artificial Sequence
  Synthetic polypeptide
atgcagcaaaaaacagcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggtaccgctgcagctag

SEQ ID NO: 7806 - DNA, 585 bp, Artificial Sequence
  Synthetic polypeptide
gatcattttttaggctgtttcacaaggcattcctgcatcagtggcagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctga

SEQ ID NO: 7807 - DNA, 425 bp, Artificial Sequence
  Synthetic polypeptide
tgctgtggtttgaatgtgttccctaaagcttattggaaacttaatccccactgcaacagcactgagaagtgggagctttaacagctgagctgattaggtcttgagggctccattccttgttactgggttaatgtcattataatgggagtaagttaatcagccagggagtgagttcctgataaaaagatgagttccccaattcccctcttctcttctgcaacagacatgctctcttgaccttctgccttctcccatgggatgactcagcaagaagacccttgttaaatgtgtgcccctcagccttggacttagcctgcagaactataatgatggttgcagggcccctcttcaatggaggcattgccagccttctggccatgaaggagaaagtgatttcaactaacccaggaaactcttacctctaa

SEQ ID NO: 7808 - DNA, 1219 bp, Artificial Sequence
  Synthetic polypeptide
aagtacagggaatgtagtagtatccttggggagctctcaggcagtgaggaatgagagtccatttctaaaccctccctctatctagaagaggctgttccaaggtgggctccacacactccctccagggccccagtgcgactgagccccagttgtccctggatgtaacctgcccttttccttttctcttatgggattttcctgttctctctccctgctccctcatttctgcttcctaggatctcctcccaaacgaacctcagacatccaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctggctccccttccgtggcccagaagtcagaactgcccccccgcacctccaatcccactcgatctcgctcccatgagccggaagccatccacatcccacaccgaaagccccaaggcgtggacccggcctccttccacttccttgacaccccaatcgccaaggtctcagagctccagcaacggctccggggcacccaggacgggagcaagcactttgtgaggtcccccaaggcccagggcaagagtgtgggtgtgggccacgtggccagaggggcaagaaacaagccccctctgggacccgccatccctgcggtgtccccctccgcccacctggctgccagcccggccctcctcccctccctagcccccctcgggcacaagaagcacaagcaccgagccaaggagagccagcagggctgccggggcctgcaggcaccactggcctcaggtggccctgtcctggggcgggagcacctgcgggagctgcccgccttggtggtgtatgagagccaggccgggcagccggtccagagacatgagcaccaccaccaccatgaacatcaccaccattaccaccacttctaccagacatag

SEQ ID NO: 7809 - DNA, 2000 bp, Artificial Sequence
  Synthetic polypeptide
tggggcctgtccacactgccgtggtcttatcttgtgactctggcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctga

SEQ ID NO: 7810 - DNA, 1157 bp, Artificial Sequence
  Synthetic polypeptide
tggggcctgtccacactgccgtggtcttatcttgtgactctggcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggctcgcgctgcctgtgtggtgtcgcgccttctcccccccggggctgggttggcgcaccctcccctcccgtctactcattccccggggcgtttctttgccgatttttgaatgtgattttaaagagtgaaaaatga

SEQ ID NO: 7811 - DNA, 1084 bp, Artificial Sequence; identical to SEQ ID NO: 580
  Synthetic polypeptide

SEQ ID NO: 7812 - DNA, 2725 bp, Artificial Sequence; identical to SEQ ID NO: 6753
  Synthetic polypeptide

SEQ ID NO: 7813 - DNA, 524 bp, Artificial Sequence
  Synthetic polypeptide
gtccccagcaggctttgtggccctgggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctccctggagggcaagcctttgtga

SEQ ID NO: 7814 - DNA, 502 bp, Artificial Sequence
  Synthetic polypeptide
gtccccagcaggctttgtggccctgggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctc

SEQ ID NO: 7815 - DNA, 295 bp, Artificial Sequence
  Synthetic polypeptide
gtccccagcaggctttgtggccctgggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagac

SEQ ID NO: 7816 - DNA, 701 bp, Artificial Sequence; identical to SEQ ID NO: 658
  Synthetic polypeptide

SEQ ID NO: 7817 - DNA, 961 bp, Artificial Sequence; identical to SEQ ID NO: 6722
  Synthetic polypeptide

SEQ ID NO: 7818 - DNA, 80 bp, Artificial Sequence; identical to SEQ ID NO: 6364
  Synthetic polypeptide

SEQ ID NO: 7819 - DNA, 217 bp, Artificial Sequence; identical to SEQ ID NO: 6365
  Synthetic polypeptide

SEQ ID NO: 7820 - DNA, 242 bp, Artificial Sequence
  Synthetic polypeptide
cagtggaaagagtgtggcactggagatttgcatattttcaaattccagctcaggcccttgcctgttcgcctttctgagcctcatttttttcttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctc

SEQ ID NO: 7821 - DNA, 398 bp, Artificial Sequence
  Synthetic polypeptide
cagtggaaagagtgtggcactggagatttgcatattttcaaattccagctcaggcccttgcctgttcgcctttctgagcctcatttttttcttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatc

SEQ ID NO: 7822 - DNA, 842 bp, Artificial Sequence
  Synthetic polypeptide
cagtggaaagagtgtggcactggagatttgcatattttcaaattccagctcaggcccttgcctgttcgcctttctgagcctcatttttttcttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcatcgagctcctggggatggtcctgtccatctgcttgtgccggcacgtccattccgaagactacagcaaggtccccaagtactga

SEQ ID NO: 7823 - DNA, 767 bp, Artificial Sequence
  Synthetic polypeptide
cagtggaaagagtgtggcactggagatttgcatattttcaaattccagctcaggcccttgcctgttcgcctttctgagcctcatttttttcttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcatcgagctcctggggatggtcctgtccatctgcttgtgccggcacgtccattccgaagactacagcaaggtccccaagtactga

SEQ ID NO: 7824 - DNA, 362 bp, Artificial Sequence
  Synthetic polypeptide
cagtggaaagagtgtggcactggagatttgcatattttcaaattccagctcaggcccttgcctgttcgcctttctgagcctcatttttttcttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttc

SEQ ID NO: 7825 - DNA, 383 bp, Artificial Sequence
  Synthetic polypeptide
cagtggaaagagtgtggcactggagatttgcatattttcaaattccagctcaggcccttgcctgttcgcctttctgagcctcatttttttcttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaaggtaagcccc

SEQ ID NO: 7826 - DNA, 352 bp, Artificial Sequence
  Synthetic polypeptide
cagtggaaagagtgtggcactggagatttgcatattttcaaattccagctcaggcccttgcctgttcgcctttctgagcctcatttttttcttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccct

SEQ ID NO: 7827 - DNA, 568 bp, Artificial Sequence
  Synthetic polypeptide
cagtggaaagagtgtggcactggagatttgcatattttcaaattccagctcaggcccttgcctgttcgcctttctgagcctcatttttttcttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcga

SEQ ID NO: 7828 - DNA, 171 bp, Artificial Sequence; identical to SEQ ID NO: 6873
  Synthetic polypeptide

SEQ ID NO: 7829 - DNA, 633 bp, Artificial Sequence; identical to SEQ ID NO: 6874
  Synthetic polypeptide

SEQ ID NO: 7830 - DNA, 636 bp, Artificial Sequence; identical to SEQ ID NO: 6875
  Synthetic polypeptide

SEQ ID NO: 7831 - DNA, 480 bp, Artificial Sequence; identical to SEQ ID NO: 6876
  Synthetic polypeptide

SEQ ID NO: 7832 - DNA, 695 bp, Artificial Sequence
  Synthetic polypeptide
cccaagggagtgactagccactgggtgacactggtacagtagctccagaaaaatgcttatttggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttga

SEQ ID NO: 7833 - DNA, 95 bp, Artificial Sequence
  Synthetic polypeptide
cccaagggagtgactagccactgggtgacactggtacagtagctccagaaaaatgcttatttggggcaatgctaaatattgcggcagttttatag

SEQ ID NO: 7834 - DNA, 601 bp, Artificial Sequence
  Synthetic polypeptide
gtgtttattagagcaggctgtgaggttgtggactccatctggattaggatccttgccccgctgtttgttaactgtgtgatcttgagcaggttaccccacctctctgagcctccgtgtcctcatctgtacaacgtggaggatacgggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacgtggagtgcagtggcacaatcccagctcgctgcaacctccgcctcccgggttcaagtgattctcctgcctccgcctcccaagtagctgggattacagaagtcacctgcaccggtgcccgtgacgtacgagctgcccacactgtatag

SEQ ID NO: 7835 - DNA, 442 bp, Artificial Sequence
  Synthetic polypeptide
gtgtttattagagcaggctgtgaggttgtggactccatctggattaggatccttgccccgctgtttgttaactgtgtgatcttgagcaggttaccccacctctctgagcctccgtgtcctcatctgtacaacgtggaggatacgggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagagaagtcacctgcaccggtgcccgtgacgtacgagctgcccacactgtataggacggaggactattttcctgtggacgccggggaagcacagcaccacccccgcacctgccctcggcctttgtga

SEQ ID NO: 7836 - DNA, 577 bp, Artificial Sequence
  Synthetic polypeptide
gtgtttattagagcaggctgtgaggttgtggactccatctggattaggatccttgccccgctgtttgttaactgtgtgatcttgagcaggttaccccacctctctgagcctccgtgtcctcatctgtacaacgtggaggatacgggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacaagtcacctgcaccggtgcccgtgacgtacgagctgcccacactgtataggacggaggactattttcctgtggacgccggggaagcacagcaccacccccgcacctgccctcggcctttgtga

SEQ ID NO: 7837 - DNA, 406 bp, Artificial Sequence
  Synthetic polypeptide
gtgtttattagagcaggctgtgaggttgtggactccatctggattaggatccttgccccgctgtttgttaactgtgtgatcttgagcaggttaccccacctctctgagcctccgtgtcctcatctgtacaacgtggaggatacgggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagagaagtcacctgcaccggtgcccgtgacgtacgagctgcccacactgtataggacggaggactattttcctgtggacgccggggaagca

SEQ ID NO: 7838 - DNA, 325 bp, Artificial Sequence
  Synthetic polypeptide
gtgtttattagagcaggctgtgaggttgtggactccatctggattaggatccttgccccgctgtttgttaactgtgtgatcttgagcaggttaccccacctctctgagcctccgtgtcctcatctgtacaacgtggaggatacgggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagagagttaa

SEQ ID NO: 7839 - DNA, 337 bp, Artificial Sequence; identical to SEQ ID NO: 6393
  Synthetic polypeptide

SEQ ID NO: 7840 - DNA, 583 bp, Artificial Sequence
  Synthetic polypeptide
tgaatattacattacatgacaaaagggactttgcagatatacttaagattactaatcagttcaccttaaaatagaaaggtcatcctggactatctgggtgggcccagaataatcacacaaacccttaaaagcagagtttcctcctgactgagggcagaagaggaagtcagagagatttctaagcatgacacagcattggtggctcaaagatgggggccgtggaaaatgtgagaagaaatgaattcaaccaacagtgagccccagggtgtttttcctgaatgtgccatttgattccatcatggagcggctgactctgagaagaattgatccagtcactggggaaaggtaccacctcatgtacaagccacctcccaccatggagatccaggctcgcctcctgcagaacccaaaggatgctgaagagcaggtcaagctgaaaatggacctgttctacaggaactcagctgacttggagcagttgtatgggtcggccatcaccctcaatggggaccaggacccatacacagtcttcgaatacatcgagagtgggatcattaatcccctgcccaagaaaatcccctga

SEQ ID NO: 7841 - DNA, 414 bp, Artificial Sequence; identical to SEQ ID NO: 6481
  Synthetic polypeptide

SEQ ID NO: 7842 - DNA, 495 bp, Artificial Sequence
  Synthetic polypeptide
tgctgtggtttgaatgagtctcgcaaagttggtatattggaaccttaaccccccatgcagtgctgagaggtcaaacctttgagaggtgactaggtcatgagggctctgtcctcgtaaatggattaatgtcactattgtgggagaggattcgttatctcaagtgagcttgttataaaaccaagtttggctgtgtcttgctttcttgccctctcacgctgtcttccccctccatcttccgccatgggatgatgctacaaggaggccctcaccagatgcaggcttttgaccttggatttgccagcctccagaattgctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactga

SEQ ID NO: 7843 - DNA, 373 bp, Artificial Sequence
  Synthetic polypeptide
tgctgtggtttgaatgagtctcgcaaagttggtatattggaaccttaaccccccatgcagtgctgagaggtcaaacctttgagaggtgactaggtcatgagggctctgtcctcgtaaatggattaatgtcactattgtgggagaggattcgttatctcaagtgagcttgttataaaaccaagtttggctgtgtcttgctttcttgccctctcacgctgtcttccccctccatcttccgccatgggatgatgctacaaggaggccctcaccagatgcaggcttttgaccttggatttgccagcctccagaattgctttctccaccaccacaacagcatgtggtctgacagaattggcttcaaagaagaaactaa

SEQ ID NO: 7844 - DNA, 1960 bp, Artificial Sequence
  Synthetic polypeptide
cccctctgatgggacaattctgagataaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagcaccatggtgcaggaatttgtacacctgggggccatagacatgtatctgcgaaaacgtggccacctggtgccagccagctggaagctgcaggtggtcaaacagctggcctacgccctcaactatctggaggacaaaggcctgccccatggcaatgtctctgcccggaaggtgctcctggctcgggagggggctgatgggagcccgcccttcatcaagctgagtgaccctggggtcagccccgctgtgttaagcctggagatgctcaccgacaggatcccctgggtggcccccgagtgtctccgggaggcgcagacacttagcttggaagctgacaagtggggcttcggcgccacggtctgggaagtgtttagtggcgtcaccatgcccatcagtgccctggatcctgctaagaaactccaattttatgaggaccggcagcagctgccggcccccaagtggacagagctggccctgctgattcaacagtgcatggcctatgagccggtccagaggccctccttccgagccgtcattcgtgacctcaatagcctcatctcttcagactatgagctcctctcagaccccacacctggtgccctggcacctcgtgatgggctgtggaatggtgcccagctctatgcctgccaagaccccacgatcttcgaggagagacacctcaagtacatctcacagctgggcaagggcaactttggcagcgtggagctgtgccgctatgacccgctaggcgacaatacaggtgccctggtggccgtgaaacagctgcagcacagcgggccagaccagcagagggactttcagcgggagattcagatcctcaaagcactgcacagtgatttcattgtcaagtatcgtggtgtcagctatggcccgggccgccagagcctgcggctggtcatggagtacctgcccagcggctgcttgcgcgacttcctgcagcggcaccgcgcgcgcctcgatgccagccgcctccttctctattcctcgcagatctgcaagggcatggagtacctgggctcccgccgctgcgtgcaccgcgacctggccgcccgaaacatcctcgtggagagcgaggcacacgtcaagatcgctgacttcggcctagctaagctgctgccgcttgacaaagactactacgtggtccgcgagccaggccagagccccattttctggtatgcccccgaatccctctcggacaacatcttctctcgccagtcagacgtctggagcttcggggtcgtcctgtacgagctcttcacctactgcgacaaaagctgcagcccctcggccgagttcctgcggatgatgggatgtgagcgggatgtccccgccctctgccgcctcttggaactgctggaggagggccagaggctgccggcgcctcctgcctgccctgctgaggttcacgagctcatgaagctgtgctgggcccctagcccacaggaccggccatcattcagcgccctgggcccccagctggacatgctgtggagcggaagccgggggtgtgagactcatgccttcactgctcacccagagggcaaacaccactccctgtccttttcatag

SEQ ID NO: 7845 - DNA, 1870 bp, Artificial Sequence
  Synthetic polypeptide
cccctctgatgggacaattctgagataaaagtccaacctgatcgtggtccagagaggtcacagcccacccacatcatccttggttcagccccaatcccaataccagctgagtcagatgacatttcacaagatccctgctgacagcctggagtggcatgagaacctgggccatgggtccttcaccaagatttaccggggctgtcgccatgaggtggtggatggggaggcccgaaagacagaggtgctgctgaaggtcatggatgccaagcacaagaactgcatggagtcattcctggaagcagcgagcttgatgagccaagtgtcgtaccggcatctcgtgctgctccacggcgtgtgcatggctggagacagcaccatggtgcaggaatttgtacacctgggggccatagacatgtatctgcgaaaacgtggccacctggtgccagccagctggaagctgcaggtggtcaaacagctggcctacgccctcaactatctggaggacaaaggcctgccccatggcaatgtctctgcccggaaggtgctcctggctcgggagggggctgatgggagcccgcccttcatcaagctgagtgaccctggggtcagccccgctgtgttaagcctggagatgctcaccgacaggatcccctgggtggcccccgagtgtctccgggaggcgcagacacttagcttggaagctgacaagtggggcttcggcgccacggtctgggaagtgtttagtggcgtcaccatgcccatcagtgccctggatcctgctaagaaactccaattttatgaggaccggcagcagctgccggcccccaagtggacagagctggccctgctgattcaacagtgcatggcctatgagccggtccagaggccctccttccgagccgtcattcgtgacctcaatagcctcatctcttcagactatgagctcctctcagaccccacacctggtgccctggcacctcgtgatgggctgtggaatggtgcccagctctatgcctgccaagaccccacgatcttcgaggagagacacctcaagtacatctcacagctgggcaagggcaactttggcagcgtggagctgtgccgctatgacccgctaggcgacaatacaggtgccctggtggccgtgaaacagctgcagcacagcgggccagaccagcagagggactttcagcgggagattcagatcctcaaagcactgcacagtgatttcattgtcaagtatcgtggtgtcagctatggcccgggccgccagagcctgcggctggtcatggagtacctgcccagcggctgcttgcgcgacttcctgcagcggcaccgcgcgcgcctcgatgccagccgcctccttctctattcctcgcagatctgcaagggcatggagtacctgggctcccgccgctgcgtgcaccgcgacctggccgcccgaaacatcctcgtggagagcgaggcacacgtcaagatcgctgacttcggcctagctaagctgctgccgcttgacaaagactactacgtggtccgcgagccaggccagagccccattttctggtatgcccccgaatccctctcggacaacatcttctctcgccagtcagacgtctggagcttcggggtcgtcctgtacgagctcttcacctactgcgacaaaagctgcagcccctcggccgagttcctgcggatgatgggatgtgagcgggatgtccccgccctctgccgcctcttggaactgctggaggagggccagaggctgccggcgcctcctgcctgccctgctgaggtgagcgccgcagggctagcctcagtttcccagtctgtagattgggccggggtctcgggcaagccagctggcgcctga

SEQ ID NO: 7846 - DNA, 664 bp, Artificial Sequence
  Synthetic polypeptide
ccaagagtagaacaaagatggaggactaggtcataaaagacactgcaactcctctctctctctctctctctctctctctctctctctgtctctctctctttctttatttctctctcttgttgttcactctccagggagccagttgccatgtcatggggaggacactcaggcagccccgtggggagactcatgtgaggaggaactgagatgtcttgccaacatccatatgagggagccatcttgtaaatgaatcttccagtcccaatcaagtcttcagatgaccagagcctcagctgataacttggctgcagcctcatgagagatcctgagccagaaccactcagccaaggactcatctgatgatgtgagaagagttcagaggagggagaaaaatcgtattgccgcccagaagagccgacagaggcagacacagaaggccgacaccctgcacctggagagcgaagacctggagaaacagaacgcggctctacgcaaggagatcaagcagctcacagaggaactgaagtacttcacgtcggtgctgaacagccacgagcccctgtgctcggtgctggccgccagcacgccctcgccccccgaggtggtgtacagcgcccacgcattccaccaacctcatgtcagctccccgcgcttccagccctga

SEQ ID NO: 7847 - DNA, 508 bp, Artificial Sequence
  Synthetic polypeptide
ccaagagtagaacaaagatggaggactaggtcataaaagacactgcaactcctctctctctctctctctctctctctctctctctctgtctctctctctttctttatttctctctcttgttgttcactctccagggagccagttgccatgtcatggggaggacactcaggcagccccgtggggagactcatgtgaggaggaactgagatgtcttgccaacatccatatgagggagccatcttgtaaatgaatcttccagtcccaatcaagtcttcagatgaccagagcctcagctgataacttggctgcagcctcatgagagatcctgagccagaaccactcagccaaggactcatctgatgatgtgagaagagttcagaggagggagaaaaatcgtattgccgcccagaagagccgacagaggcagacacagaagagtattaagaaagatgctcaagtcccatggcacagagcaaggcgggcagggaacggttatttttctaaataa

SEQ ID NO: 7848 - DNA, 2360 bp, Artificial Sequence
  Synthetic polypeptide
tgatacggtttggctgtgtccccacccaaatctcaacttgaattgtatctcccagaattcccacatgttgcaggagggatccagggggaggtaattgaatcacccacatgtagcgggagggacccagggggaggtaattgaatcatgggggtcggtctttcctgtgctgttcttgtcacagtaagtctcacgaggtctgatgggtttatcaggggtttccacttttgcttcttcctcatttttctcttgccgctgccaatgtaagaagtgccttgtgcctcccaccatgattctgaggcctccacagccatgtggaactggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccggacacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgttgtaaggatgcgaggcagcgggaggcagtgctggatgacggagacgccaaacgctttgttgtggcataatgtgtctggagttggttcctgccggtgggttcgtggtctcgctgacttcaaggatgaagccaccgactttcgcgttatgccacgggaccccagcctgcactgccatgtgacttcaaccgcatga

SEQ ID NO: 7849 - DNA, 2657 bp, Artificial Sequence
  Synthetic polypeptide
tgatacggtttggctgtgtccccacccaaatctcaacttgaattgtatctcccagaattcccacatgttgcaggagggatccagggggaggtaattgaatcacccacatgtagcgggagggacccagggggaggtaattgaatcatgggggtcggtctttcctgtgctgttcttgtcacagtaagtctcacgaggtctgatgggtttatcaggggtttccacttttgcttcttcctcatttttctcttgccgctgccaatgtaagaagtgccttgtgcctcccaccatgattctgaggcctccacagccatgtggaactggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccggacacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgtgagcaacgcccgctacgtggggcccaagcagaaggccccgcccttcccacagccccagttcatccccatgaagggccagatcagacccatggtgcccccgccgcagctctacgtccccgtcaacggctaccagccggtgccggcctatggggcctacctgcccaacttctacccggtgcagatcccaatgcagatggccccgcagcaggtgcctcctcagatggtccccaagcccagctcacaccacagtggcagtggctccaccagcacaggctacgtcaccacggccccctccaacacatccatggcagacagggcagccctgctctcagagggcgctgatgacacacagaacgccccagaagatggggcccagagcaccgtgcaggaagcagaggaggaggaggaaggctctgtcccagagactgagctgctgggggactgtgacactctgcaggtggacgaggcccaagtccagctggaagcttga

SEQ ID NO: 7850 - DNA, 163 bp, Artificial Sequence; identical to SEQ ID NO: 480
  Synthetic polypeptide

SEQ ID NO: 7851 - DNA, 104 bp, Artificial Sequence; identical to SEQ ID NO: 481
  Synthetic polypeptide

SEQ ID NO: 7852 - DNA, 742 bp, Artificial Sequence; identical to SEQ ID NO: 6357
  Synthetic polypeptide

SEQ ID NO: 7853 - DNA, 590 bp, Artificial Sequence; identical to SEQ ID NO: 6358
  Synthetic polypeptide

SEQ ID NO: 7854 - DNA, 577 bp, Artificial Sequence; identical to SEQ ID NO: 6359
  Synthetic polypeptide

SEQ ID NO: 7855 - DNA, 430 bp, Artificial Sequence; identical to SEQ ID NO: 6360
  Synthetic polypeptide

SEQ ID NO: 7856 - DNA, 670 bp, Artificial Sequence; identical to SEQ ID NO: 6361
  Synthetic polypeptide

SEQ ID NO: 7857 - DNA, 1767 bp, Artificial Sequence
  Synthetic polypeptide
tgctctgctcatatcatcccccttgctgcctcctccgtgttaccaagactcagttcaggcatgaagtctccgtgggctctgagggttcggggctcttccggggtagaatttgtcgttcccacctctgttttccatggcactttgtacagactcctgtacaaagacctctgtacatgtgtcacgctgttttgtgatcatgtgtttctgtgtctgtctccctcagtagactgtgagctcctcgagggcaggaaccgtgtcttactcatctctgtattcccagcgcctagcacagtgcctggcacagaccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagcagagatccgtgaggaggaggtacagacggtggaggatggggtgtttgacatccacttgtaa

SEQ ID NO: 7858 - DNA, 1764 bp, Artificial Sequence
  Synthetic polypeptide
tgctctgctcatatcatcccccttgctgcctcctccgtgttaccaagactcagttcaggcatgaagtctccgtgggctctgagggttcggggctcttccggggtagaatttgtcgttcccacctctgttttccatggcactttgtacagactcctgtacaaagacctctgtacatgtgtcacgctgttttgtgatcatgtgtttctgtgtctgtctccctcagtagactgtgagctcctcgagggcaggaaccgtgtcttactcatctctgtattcccagcgcctagcacagtgcctggcacagaccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaa

SEQ ID NO: 7859 - DNA, 630 bp, Artificial Sequence
  Synthetic polypeptide
tgctctgctcatatcatcccccttgctgcctcctccgtgttaccaagactcagttcaggcatgaagtctccgtgggctctgagggttcggggctcttccggggtagaatttgtcgttcccacctctgttttccatggcactttgtacagactcctgtacaaagacctctgtacatgtgtcacgctgttttgtgatcatgtgtttctgtgtctgtctccctcagtagactgtgagctcctcgagggcaggaaccgtgtcttactcatctctgtattcccagcgcctagcacagtgcctggcacagaccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggag

SEQ ID NO: 7860 - DNA, 405 bp, Artificial Sequence
  Synthetic polypeptide
ggccaagcacaatgagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagctgccaacaagaagcattag

SEQ ID NO: 7861 - DNA, 274 bp, Artificial Sequence
  Synthetic polypeptide
ggccaagcacaatgagctctggcagccttcctcaaaaagtccgggaagctgaaagtccccgaatgggtggataccgtcaagctggccaagcacaaagagcttgctccctacgatgagaactggttctacacgcgagctggtggtttaatcctttctatatacacggaggcagactccctgggtttggatccatcttttacatctggctgtgtgtcctctgcttccacagcgcggcacctgtacctccggggtggcgctggggttggctccatga

SEQ ID NO: 7862 - DNA, 196 bp, Artificial Sequence
  Synthetic polypeptide
ggccaagcacaatgagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgacca

SEQ ID NO: 7863 - DNA, 268 bp, Artificial Sequence
  Synthetic polypeptide
ggccaagcacaatgagctctggcagccttcctcaaaaagtccgggaagctgaaagtccccgaatgggtggataccgtcaagctggccaagcacaaagagcttgctccctacgatgagaactggttctacacgcgagctggtgaggaacttagcttccacagcgcggcacctgtacctccggggtggcgctggggttggctccatgaccaagatctatgggggacgtcagagaaacggcgtcatgcccagccacttcagccgaggctcc

SEQ ID NO: 7864 - DNA, 186 bp, Artificial Sequence
  Synthetic polypeptide
ggccaagcacaatgagctctggcagccttcctcaaaaagtccgggaagctgaaagtccccgaatgggtggataccgtcaagctggccaagcacaaagagcttgctccctacgatgagaactggttctacacgcgagctgagttgcactgtcaccaggctggagtacactggtgccgtctcggctaa

SEQ ID NO: 7865 - DNA, 695 bp, Artificial Sequence
  Synthetic polypeptide
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagaaagacacaccgacctggaccaagggagacaggcataaacagctccaaagggaaacacacgggaaaaagagagaacaagagaaagaaatagacgccctgaaagaagagacagagacttatgagccgtag

SEQ ID NO: 7866 - DNA, 590 bp, Artificial Sequence
  Synthetic polypeptide
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtcctcggcagcctgatcttctgcttcggcatctggatcctcattgacaagaccagcttcgtgtcctttgcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtag

SEQ ID NO: 7867 - DNA, 1070 bp, Artificial Sequence
  Synthetic polypeptide
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttag

SEQ ID NO: 7868 - DNA, 1037 bp, Artificial Sequence
  Synthetic polypeptide
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgaggtgatctggccccgcccccacccgcgatcggccctaaatccctag

SEQ ID NO: 7869 - DNA, 706 bp, Artificial Sequence
  Synthetic polypeptide
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtcctcggcagcctgatcttctgcttcggcatctggatcctcattgacaagaccagcttcgtgtcctttgtgggcaggctacaggctcccatccactgctcaccggaggcttcttggagcctgagtcttcttccggcaaatggggttgtgcatacaaacaacaatgatcatgagagccatttctcaagcacttcctatctgtcgggacttgtggctggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggc

SEQ ID NO: 7870 - DNA, 1148 bp, Artificial Sequence; identical to SEQ ID NO: 436
  Synthetic polypeptide

SEQ ID NO: 7871 - DNA, 3046 bp, Artificial Sequence
  Synthetic polypeptide
tgatacggttaggctttgcgtccccacccaaatctcatcttgaattgtaatctccatcatccctacgtgtcaagggagagaccaggtggaggtagttgaatcatggggtggtttcccccatgctgttctcgtgatagtgagtgagttctcacaagatccgatggtattataaagggctcttcccctttcgctcggcacgtcttcctgctgctttgtgaaggaggtgttttgtgaccctttcgccatgattgtaaatttcctgaggccttcccagccatgctgaactatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcccgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggaaacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctga

SEQ ID NO: 7872 - DNA, 741 bp, Artificial Sequence
  Synthetic polypeptide
tgatacggttaggctttgcgtccccacccaaatctcatcttgaattgtaatctccatcatccctacgtgtcaagggagagaccaggtggaggtagttgaatcatggggtggtttcccccatgctgttctcgtgatagtgagtgagttctcacaagatccgatggtattataaagggctcttcccctttcgctcggcacgtcttcctgctgctttgtgaaggaggtgttttgtgaccctttcgccatgattgtaaatttcctgaggccttcccagccatgctgaactatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcc

SEQ ID NO: 7873 - DNA, 665 bp, Artificial Sequence; identical to SEQ ID NO: 6374
  Synthetic polypeptide

SEQ ID NO: 7874 - DNA, 518 bp, Artificial Sequence; identical to SEQ ID NO: 6375
  Synthetic polypeptide

SEQ ID NO: 7875 - DNA, 186 bp, Artificial Sequence; identical to SEQ ID NO: 7638
  Synthetic polypeptide

SEQ ID NO: 7876 - DNA, 309 bp, Artificial Sequence
  Synthetic polypeptide
tacatttagcctgagggatggctcttgagcccttaaataatgaactgcaacctaacttagtatgtaaactaactgaaagcttaaggcatgggagtatacttttgtaacaaatagctgagtctcagccaatcccagtagccgaacttcagtcggcggcagtcaaccctgcagccaagtgatcagactatgttcaaataaggccaactctgagctgtaaccaattaagctgtttctgtgtgtcacttcccttgtggaatggagctcactgaacctctctgatggctgcccgatcgttctgatgggtggtga

SEQ ID NO: 7877 - DNA, 213 bp, Artificial Sequence
  Synthetic polypeptide
aagatttggggtcagagtcccaagctgcgtcatttagtagaagccgagtgactttgaacaaatcgttgcttttgtctgagcctgggtttcctcctgtacaaactgaaggagccaagccgccatggcctaccacagcttcctggtggagcccatcagctgccacgcctggaacaaggaccgcacccagattgccatctgccccaacaaccatga

SEQ ID NO: 7878 - DNA, 330 bp, Artificial Sequence; identical to SEQ ID NO: 6490
  Synthetic polypeptide

SEQ ID NO: 7879 - DNA, 1306 bp, Artificial Sequence
  Synthetic polypeptide
ccaacaacatatatatattttcaggaaaaagacctcctctacaaaagcaatttcaaaaaactggaagaaatgactgttgtaccacatgggcagatatcaatgtaagaacacaggaaacatgaaaaagcaaggaaatatgatacctccaaaggaacacacaattctccagcaaaaaaatcccaatcaaaaagaaattcacaaaaccccagatgaacaattcaaaatattgattttaaagaagctaaataagatataagagaattctgaaaaacaatagagagaattcagaaaaacagttcaggatatgaatgagaaatttatcaaagaaatagatatttttaaaagaaccaaacagaaattctggaactaaagattcattgaatgcaataaaaaatacatcccaaactccaccaatagactagatcaggcaaaagaaagaatctcagaacttgaagacaggtcttttgaaacaacctattcagacaaaaataaagagaaaagaataaaaaagaatgagcaaacccttcatgatatatggggcagtgtaaagcaactgaatattcaaatcatcagtgtccccaagggtgaagagagaatgaaagattagaaatcctatttaatgaaatattagatcaaaacttcccaaatataacaacaaacctagacatccagatgcaggaggcccaaaggtccccaaacagatacaatgcaaaatcatcttctccacagcacgttataatcaaaccacttaaagtcaaagcaaaagcaaatatactaaaaagagcaaaagaaaatcttctaattacccataaaggaaccaccattagactaacagtggatttctcagcagacaccttacaggccaggagagaaggggatgacattttcaaagtgctgaaagaaaaatactgccacccaaggagaccatgtccagcaaaactattcttcataaataaaagaaaaataaagcctttcccaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaa

SEQ ID NO: 7880 - DNA, 1130 bp, Artificial Sequence
  Synthetic polypeptide
cagagtggctgagaggggctctggagccagctgcctggatttgaatcccagctgtgccacttaccagctgtgtgactgtaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatga

SEQ ID NO: 7881 - DNA, 871 bp, Artificial Sequence; identical to SEQ ID NO: 437
  Synthetic polypeptide

SEQ ID NO: 7882 - DNA, 421 bp, Artificial Sequence; identical to SEQ ID NO: 441
  Synthetic polypeptide

SEQ ID NO: 7883 - DNA, 638 bp, Artificial Sequence; identical to SEQ ID NO: 442
  Synthetic polypeptide

SEQ ID NO: 7884 - DNA, 337 bp, Artificial Sequence; identical to SEQ ID NO: 443
  Synthetic polypeptide

SEQ ID NO: 7885 - DNA, 1134 bp, Artificial Sequence
  Synthetic polypeptide
tttcttggctccctgacccagaagcaaggtgactgacggaaggctgaggcagccccttaggtggcttaagcctgccctgtggagcatccctgtggggtactccgggcagcctgagtgatgagatccaaagagcgctcctgggtaggaaattgccccagtggaacacctcaccagatcaacacgtagcaggcccccgtggaggattaacacagtggctgaacaccgggaaggaactggcacttggagtctggacatctggaacttggaagacccactacattatttgagacaatggggaaagctgaaatgtggctcattcgaacctattgggattttgaatttcctcgcccattcttaccaaatgttgattttgttggaggacttcactgtaaaccagccaaacccttgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtataagtggttaccccagaatgaccttcttggtcatcccaaaaccaaagcttttataactcatggtggaaccaatggcatctatgaggcaatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctatctataaagagaatatcatgaaattatcaagaattcatcatgatcaaccggtgaagcccctggatcgagcagtcttctggattgagtttgtcatgcgccataaaggagccaagcaccttcgggtcgcagcccacaacctcacctggatccagtaccactctttggatgtgatagcattcctgctggcctgcgtggcaactatgatatttatgatcacaaaatgttgcctgttttgtttccgaaagcttgccaaaacaggaaagaagaagaaaagggattag

SEQ ID NO: 7886 - DNA, 423 bp, Artificial Sequence; identical to SEQ ID NO: 6550
  Synthetic polypeptide

SEQ ID NO: 7887 - DNA, 1926 bp, Artificial Sequence; identical to SEQ ID NO: 7679
  Synthetic polypeptide

SEQ ID NO: 7888 - DNA, 477 bp, Artificial Sequence; identical to SEQ ID NO: 7680
  Synthetic polypeptide

SEQ ID NO: 7889 - DNA, 711 bp, Artificial Sequence; identical to SEQ ID NO: 7681
  Synthetic polypeptide

SEQ ID NO: 7890 - DNA, 288 bp, Artificial Sequence; identical to SEQ ID NO: 7682
  Synthetic polypeptide

SEQ ID NO: 7891 - DNA, 237 bp, Artificial Sequence; identical to SEQ ID NO: 7683
  Synthetic polypeptide

SEQ ID NO: 7892 - DNA, 703 bp, Artificial Sequence; identical to SEQ ID NO: 7684
  Synthetic polypeptide

SEQ ID NO: 7893 - DNA, 1942 bp, Artificial Sequence
  Synthetic polypeptide
aacaccattttctagctgcacaaaactcaaggaacaaactaggaataaacctccccaagaaagcacaggggctttttaagaaggaacttctgaggactgcagagggaaacctgaattatggagacacatggtcctgaaaagaaagatgcaatactgtaaagcagcccctgtcaaagggaacaggaagcagtccacggagggtgacgccctagacccacctgcatcccccaaacctgctggcaagcagaacggaatccagaaccccatctcgctggaggactcccccgaggcaggcggggagcgggaggaggagcaggagcgggaggaggagcaggccttcctggtcagcctctacaagttcatgaaggagcgacacacgcccatcgagagggtgccccatctcggcttcaagcagattaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtag

SEQ ID NO: 7894 - DNA, 334 bp, Artificial Sequence
  Synthetic polypeptide
aacaccattttctagctgcacaaaactcaaggaacaaactaggaataaacctccccaagaaagcacaggggctttttaagaaggaacttctgaggactgcagagggaaacctgaattatggagacacatggtcctgaaaagaaagatgcaatactgtaaagcagcccctgtcaaagggaacaggaagcagtccacggagggtgacgccctagacccacctgcatcccccaaacctgctggcaagcagaacggaatccagaaccccatctcgctggagttaacctgtggaagatctacaaagcagtggagaagctgggggcctatgagctggtga

SEQ ID NO: 7895 - DNA, 259 bp, Artificial Sequence
  Synthetic polypeptide
cttccggccaggacacacactccttggccccagtgcctgcgctagtcatcccgtgatcacttcatggcatttcccctccctttccagtctttgttccatggtcacctcagtgagaccttccttggctatttaaaatggcagcaacacagtcactcctggcggcaaaccaaacaaaaccagagtcatctggggaaaagtaactcgggcccatggaaacagtggcatggttcgtgccaaattccgaagcaatcttcctgct

SEQ ID NO: 7896 - DNA, 310 bp, Artificial Sequence
  Synthetic polypeptide
cttccggccaggacacacactccttggccccagtgcctgcgctagtcatcccgtgatcacttcatggcatttcccctccctttccagtctttgttccatggtcacctcagtgagaccttccttggctatttaaaatggcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaa

SEQ ID NO: 7897 - DNA, 204 bp, Artificial Sequence
  Synthetic polypeptide
ggctgggcatggtggctcatcacgcctgtaatcccagcactttgggaggccgaggcaggcggatcacctgagatacaaactggactctcaggacaaaacgacaccagccaaaccagcagcccctcagcatccagcaacataagcggaggcattttccttttcttcgtggccaatgccataatccacctcttctgcttcagttga

SEQ ID NO: 7898 - DNA, 1033 bp, Artificial Sequence; identical to SEQ ID NO: 7576
  Synthetic polypeptide

SEQ ID NO: 7899 - DNA, 1048 bp, Artificial Sequence; identical to SEQ ID NO: 7577
  Synthetic polypeptide

SEQ ID NO: 7900 - DNA, 990 bp, Artificial Sequence
  Synthetic polypeptide
gctgggcgcagtggctcatgcctgtaatgccagcactttgagaggccgaggcgggaagatcacgagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccaggtaagggccttgcagaggggcatctggtcaccagcagctcatccccagcagggccagctcctttgtgggcaggtgaaggagtgtga

SEQ ID NO: 7901 - DNA, 471 bp, Artificial Sequence
  Synthetic polypeptide
gctgggcgcagtggctcatgcctgtaatgccagcactttgagaggccgaggcgggaagatcacgagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagtactga

SEQ ID NO: 7902 - DNA, 507 bp, Artificial Sequence
  Synthetic polypeptide
gctgggcgcagtggctcatgcctgtaatgccagcactttgagaggccgaggcgggaagatcacgagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagagtcactggaactggaggacccgtcttctgggctgggtgtga

SEQ ID NO: 7903 - DNA, 723 bp, Artificial Sequence
  Synthetic polypeptide
gctgggcgcagtggctcatgcctgtaatgccagcactttgagaggccgaggcgggaagatcacgagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtga

SEQ ID NO: 7904 - DNA, 483 bp, Artificial Sequence
  Synthetic polypeptide
gctgggcgcagtggctcatgcctgtaatgccagcactttgagaggccgaggcgggaagatcacgagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccaggaagtggccaaaagctag

SEQ ID NO: 7905 - DNA, 915 bp, Artificial Sequence
  Synthetic polypeptide
gctgggcgcagtggctcatgcctgtaatgccagcactttgagaggccgaggcgggaagatcacgagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccagtccccatgtga

SEQ ID NO: 7906 - DNA, 393 bp, Artificial Sequence
  Synthetic polypeptide
gctgggcgcagtggctcatgcctgtaatgccagcactttgagaggccgaggcgggaagatcacgagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagccccatgcagaatgccaccaagtatggcaacatgacagaggaccatgtgatgcacctgctccagaatgctga

SEQ ID NO: 7907 - DNA, 183 bp, Artificial Sequence
  Synthetic polypeptide
gctgggcgcagtggctcatgcctgtaatgccagcactttgagaggccgaggcgggaagatcacgagccagtcatggatgaccagcgcgaccttatctccaacaatgagcaactgcccatgctgggccggcgccctggggccccggagagcccatgcagaatgccaccaagtatggcaacatga

SEQ ID NO: 7908 - DNA, 832 bp, Artificial Sequence
  Synthetic polypeptide
gatttaaatgagattgccagcctagagagggtctctattggcatgccgtagagctctgccattggctattttttgtagaacttattaatgacttggatgaagaaaaggaagacctgtgtgttaagttagtggatggcttaaagctgtgtgctgtcaccattcatgagacgatgcaattgagattccaaaagattttgcaattttgctggtctggaagatgtccaaataaggaatgaaattcagtggagatggatgtaaaatcctacccttaagccccatagcatccatcatcatccaaggacggacggagaagcagcacatgcagataaagcttgcatttctctgcaggctcagagagaatcctcagcggcttgggcccagcacaggagaggtcactgccacacatttgcccttggcatggtctccagaaccatgcattgcatcctgggagcaacattttctgagatattctggtaaattggagtgtgtgttggtgagggtccccagaatggcaaagaagagcctgatgcaaggaactcagaggacctgagatgctgtatcctaacatttcaagaactgcgatattgaaaaaagcattggatctactagatgtggttctattaaatggaaccaaacccaacaggaatatgagagcctggagcaagaaaacaccatgctgcggagagagatcgggaagctgacagaggagctgaagcacctgacagaggcactgaaggagcacgagaagatgtgcccgctgctgctctgccctatgaactttgtgccagtgcctccccggccggaccctgtggccggctgcttgccccgatga

SEQ ID NO: 7909 - DNA, 1332 bp, Artificial Sequence
  Synthetic polypeptide
gtaaccatcataaaaaattcaacaagtaacgacaaattctcttgaagcaagtaaaaaaaaatggaaattctcagtgaagaaataggaattaacaaaaaagaaccaaatggaaactatagaaccaaaaaataacacaaataataaaactaactggatgagcttaatagtacagtggagatgacagagaatagaaattgaggacagatcaatagaatgttcccgatctgaacaaccgataaacaataaactgaaaacagagtctcagaaacctgtgggacaataacaaagatccaacatttatagcattgacatcctagaaggagaagagtgaaacaatgggactaaaagagtactaaaagaagtaatggctggaaattccccacatttggcaaaaaatagaaacctacagattcaagaggctgagagaactccgacaggataaacccaaagcaatcaatgccaagaaacattataattaaatttctgaaaactacagacaaagaaaaaaatttgaaagcagccagggagaaacaatgcatggccaaacacccatttgaatggcagcatatttctcatctaaagcaacagcagcctgaaggaagtgacaaaagatttttcaactgatgaaagagaagaactgtcaacagaaaattctgtatctggtgaaactatatttcacgagtgaatggggaaatacgttctcacataaagggaatctaaaagaattgtcactagcagatctcttcttaaagaatggctaaaggaagttcttcgaaagaaaggaaatgataaagaaaggatcttagacgatcaggaagaaggaaagaacaagggagaaagcagaaatatggaaaattggccctgaaacaccatccagacaagaatccagatgatccagctgctactgagaagtttaaagaaatcaacaacgcccacgcaatacttaccgacatttcaaagagaagcatatacgacaagtacggatcgctgggactctacgtggccgagcagtttggagacgaaaacgttaacacctacttcatgctgtcgagctggtgggcaaaggccctgtttgtcatcgttggcctcttgacgggctgctacttttgctgctgcctgtgctgctgctgcaactgctgctgtggacactgccggcccgagtcatcagtgccagaagaggacttctatgtgtccccagaggatctggaggagcagatcaagtctgacatggaaaaagatgtggactttccagtttttctccagcctacaaatgcaaatgagaaaacacagctaatcaaagaaggatctcgaagttattgcacagactcttga

SEQ ID NO: 7910 - DNA, 1021 bp, Artificial Sequence
  Synthetic polypeptide
gtaaccatcataaaaaattcaacaagtaacgacaaattctcttgaagcaagtaaaaaaaaatggaaattctcagtgaagaaataggaattaacaaaaaagaaccaaatggaaactatagaaccaaaaaataacacaaataataaaactaactggatgagcttaatagtacagtggagatgacagagaatagaaattgaggacagatcaatagaatgttcccgatctgaacaaccgataaacaataaactgaaaacagagtctcagaaacctgtgggacaataacaaagatccaacatttatagcattgacatcctagaaggagaagagtgaaacaatgggactaaaagagtactaaaagaagtaatggctggaaattccccacatttggcaaaaaatagaaacctacagattcaagaggctgagagaactccgacaggataaacccaaagcaatcaatgccaagaaacattataattaaatttctgaaaactacagacaaagaaaaaaatttgaaagcagccagggagaaacaatgcatggccaaacacccatttgaatggcagcatatttctcatctaaagcaacagcagcctgaaggaagtgacaaaagatttttcaactgatgaaagagaagaactgtcaacagaaaattctgtatctggtgaaactatatttcacgagtgaatggggaaatacgttctcacataaagggaatctaaaagaattgtcactagcagatctcttcttaaagaatggctaaaggaagttcttcgaaagaaaggaaatgataaagaaaggatcttagacgatcaggaagaaggaaagaacaagggagaaagcagaaatatggaaaattggccctgaaacaccatccagacaagaatccagatgatccagctgctactgagaagtttaaagaaatcaacaacgcccacgcaatacttaccgacatttcaaagagaagcatatacgacaagtacggatcgctgggactctacgtggccgagcagtttggagacg

SEQ ID NO: 7911 - DNA, 1883 bp, Artificial Sequence; identical to SEQ ID NO: 6345
  Synthetic polypeptide

SEQ ID NO: 7912 - DNA, 118 bp, Artificial Sequence
  Synthetic polypeptide
ggcgagaggcggcggcgggagcggcgtttcatccaggatcgagcagggcgaatggggggggaggcacccgagctggccctggacccggtgcctcaggatgcgtccaccaagaagctga

SEQ ID NO: 7913 - DNA, 435 bp, Artificial Sequence
  Synthetic polypeptide
ggcgagaggcggcggcgggagcggcgtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggctggcgtgaaatggcgtgatctgggctcactgcaacctctgcctcctgggttcaagcgattcacctgcctcagcatcccaaggagctgggattacaggccctgtgcaccaaggtgccggaactga

SEQ ID NO: 7914 - DNA, 519 bp, Artificial Sequence
  Synthetic polypeptide
ggcgagaggcggcggcgggagcggcgtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctga

SEQ ID NO: 7915 - DNA, 480 bp, Artificial Sequence
  Synthetic polypeptide
ggcgagaggcggcggcgggagcggcgtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttggaccgtgaccatctttgtggcgggagtgctcaccgcctcactcaccatctggaagaagatgggctga

SEQ ID NO: 7916 - DNA, 597 bp, Artificial Sequence
  Synthetic polypeptide
ggcgagaggcggcggcgggagcggcgtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccaccgtccctgccccccgccactcctctgggaccctgggccttctggagcaggtcacagtggtgccctctccccatcttcagatcatcagatgtggtctataatgcgttttccttacgtgtctga

SEQ ID NO: 7917 - DNA, 368 bp, Artificial Sequence
  Synthetic polypeptide
tgatatggtttggctgtgtccccatccaaatctcaccttgaattgtagctcccataattcccacgtgttgtgggaggaacctaatcagagttaattgaatcataggggtgatttcccccatgctgttcttgaagtagtgaataagtctcacgagatctgaatgttttataaggggaaatccctttcacttggttttcattctctctcgtctgccaccatgaaagatgtgcgtttcacgttccactatgattgtgaggcctccccagctgcatggaactccaacatcccatgcaccatcgtggagactggctggatgccctgtgctctatcagggcatgtcagaccaacagaggggcaaatcagagtga

SEQ ID NO: 7918 - DNA, 421 bp, Artificial Sequence
  Synthetic polypeptide
tgatatggtttggctgtgtccccatccaaatctcaccttgaattgtagctcccataattcccacgtgttgtgggaggaacctaatcagagttaattgaatcataggggtgatttcccccatgctgttcttgaagtagtgaataagtctcacgagatctgaatgttttataaggggaaatccctttcacttggttttcattctctctcgtctgccaccatgaaagatgtgcgtttcacgttccactatgattgtgaggcctccccagctgcatggaactccaacatcccatgcaccatcgtggagactggctggatgccctgtgctctatcagggcatgtcagaccaacagaggggcaaatcagagtgaagaggaagccagaagatgggagagacatttttgaaggaacaagctgccaataa

SEQ ID NO: 7919 - DNA, 753 bp, Artificial Sequence
  Synthetic polypeptide
aaacatcattcttcatggggaaacctggggaaaagccccacttgaagtaaggaacgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaa

SEQ ID NO: 7920 - DNA, 873 bp, Artificial Sequence
  Synthetic polypeptide
aaacatcattcttcatggggaaacctggggaaaagccccacttgaagtaaggaacgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaagatggagtctcgcaccgtcgcccaagttggagtgcagtggcgcaatctcaactcaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtga

SEQ ID NO: 7921 - DNA, 848 bp, Artificial Sequence
  Synthetic polypeptide
ggccgggcgcggtggctcacccctgtaatcccagcagtttgggaggccgaggcgggtgcatcatctaaggtcaagagttcgagacaagtctggccaagatggggaaactgactctactctgtgatgccaagacagatgggagtttccttgtacaccactttctctccttctatctcaaagctaattgtaaagtctgctttgtggcactcatccagtccttcagccactacagtatcgtgggacagaagctgggtgtcagcctgaccatggcgcgggagcgtgggcagcttgtgttccttgagggactcaagtctgcagtggacgtcgtcttccaggctcaaaaggagccacaccccctgcagtttctcagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaagcgtgtccttttttgccaaaggaatgtctcctgctgttctgtga

SEQ ID NO: 7922 - DNA, 230 bp, Artificial Sequence
  Synthetic polypeptide
ggccgggcgcggtggctcacccctgtaatcccagcagtttgggaggccgaggcgggtgcatcatctaaggtcaagagttcgagacaagtctggccaagatggggaaactgactctactctgtgatgccaagacagatgggagtttccttgtacaccactttctctccttctatctcaaagggtgtcagcctgaccatggcgcgggagcgtgggcagcttgtgttccttga

SEQ ID NO: 7923 - DNA, 369 bp, Artificial Sequence; identical to SEQ ID NO: 6492
  Synthetic polypeptide

SEQ ID NO: 7924 - DNA, 654 bp, Artificial Sequence; identical to SEQ ID NO: 6998
  Synthetic polypeptide

SEQ ID NO: 7925 - DNA, 651 bp, Artificial Sequence; identical to SEQ ID NO: 6999
  Synthetic polypeptide

SEQ ID NO: 7926 - DNA, 498 bp, Artificial Sequence; identical to SEQ ID NO: 7000
  Synthetic polypeptide

SEQ ID NO: 7927 - DNA, 189 bp, Artificial Sequence; identical to SEQ ID NO: 7001
  Synthetic polypeptide

SEQ ID NO: 7928 - DNA, 3616 bp, Artificial Sequence
  Synthetic polypeptide
agaggattatgtgtacatggcagaatctatcccgccacctagacaacaattactctttccaagtctgtctgatgtatctattttgggaccctggtgtctaatcaaaattggcaacttccagaaggaggcttggacagtgagttgtacttaatttcagtgagtttcagctcttaacacaatagtggctgcacatcctctacccctagccctgtggcaggctttccagatgtgcatacattccagtagcagcttgtgctcaacgtgcaggggccgaatgggaaaaaatgaaccctgtcctacaaataacagggatctatgttgtgatcactgatgcctgcctctgaacacaaaggtacagacaaagaaatggcaaccatgtgtttgcaactctccctattgttgtaagcacctccccctctggctgaagtgacttccaggggatttaaagagcttgtgccttttcctgtgtctccttcatttttctccttttccctttttgggagccagacattgaagactaagacattcaaaagcaaccacatatatggggtaagttggaaagacattgaacttgcccaggggaaggtgcagcctcagaaaagacctaagaagactcttaagtgtgcagttcaggctgatccttggcaacctacaacaattacaataaacaaacaaaatccagcaaatccttgaggaagggagacaatctgatttccagagttaccatatcattagattcagatatccagttgttagcaaaaaattatgaggcataaaaagaaacaaaaacgtatggcccactcaaaggggaaaacaaagaccaacagaaacagtgcctgatgaagacctgatggcacatctactagacaaagacttttaaaaaaatcttaaagatgcttaaaaaactgaaggaaaatttggagaaagtcaagaaaatggtgtatgcattaaatgaaaatatcaaaaaagagatagaaaacataagaaagaaactaaaaagaaatgcgggagctgaaaagtacaataactgaaatgaaaattttaaaagagggattcaaaggcagatttgagcaggcagaagaaagaatcaacaaacttgtagataagacagtgaaaattatcaagtatgagaaatacaaagaaaaaaatataagaaaagtgatcagagcctaagagacatctgggttaccattaagtggaccagcttactcattgtgggagtcctaaaaggaaaagagagaagggtgcagagagaatatttgaagaaataatgatggaaaacttcccaaatttgatgaaagacatgaatataaacatccaagaagttcaatgacagctgatgaactgaaagagacccacatcgagatacactataatcaaactatccaaagtcaaagagaattttgaaaacagtgagggaaaactgatttgtctcatacaaggaattttcaataagattatgggcaaatttatcgtcagaaactttgaaggccagaagtagtggtctgatatatttaaagtgctatttttttcagctgtcaactagaaattttatacgcagaaaaaatattctccaaaagcaagggagaaattaagacattctcagataaacagaagctgaaggagttttttacttgtctttgcagtaaatgctaaagggagtccttcctgcaggttgatataaaaggacactaaacaataacttgatgccatatgaagaaaaaaagatctcagcaaagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaa

SEQ ID NO: 7929 - DNA, 3619 bp, Artificial Sequence
  Synthetic polypeptide
agaggattatgtgtacatggcagaatctatcccgccacctagacaacaattactctttccaagtctgtctgatgtatctattttgggaccctggtgtctaatcaaaattggcaacttccagaaggaggcttggacagtgagttgtacttaatttcagtgagtttcagctcttaacacaatagtggctgcacatcctctacccctagccctgtggcaggctttccagatgtgcatacattccagtagcagcttgtgctcaacgtgcaggggccgaatgggaaaaaatgaaccctgtcctacaaataacagggatctatgttgtgatcactgatgcctgcctctgaacacaaaggtacagacaaagaaatggcaaccatgtgtttgcaactctccctattgttgtaagcacctccccctctggctgaagtgacttccaggggatttaaagagcttgtgccttttcctgtgtctccttcatttttctccttttccctttttgggagccagacattgaagactaagacattcaaaagcaaccacatatatggggtaagttggaaagacattgaacttgcccaggggaaggtgcagcctcagaaaagacctaagaagactcttaagtgtgcagttcaggctgatccttggcaacctacaacaattacaataaacaaacaaaatccagcaaatccttgaggaagggagacaatctgatttccagagttaccatatcattagattcagatatccagttgttagcaaaaaattatgaggcataaaaagaaacaaaaacgtatggcccactcaaaggggaaaacaaagaccaacagaaacagtgcctgatgaagacctgatggcacatctactagacaaagacttttaaaaaaatcttaaagatgcttaaaaaactgaaggaaaatttggagaaagtcaagaaaatggtgtatgcattaaatgaaaatatcaaaaaagagatagaaaacataagaaagaaactaaaaagaaatgcgggagctgaaaagtacaataactgaaatgaaaattttaaaagagggattcaaaggcagatttgagcaggcagaagaaagaatcaacaaacttgtagataagacagtgaaaattatcaagtatgagaaatacaaagaaaaaaatataagaaaagtgatcagagcctaagagacatctgggttaccattaagtggaccagcttactcattgtgggagtcctaaaaggaaaagagagaagggtgcagagagaatatttgaagaaataatgatggaaaacttcccaaatttgatgaaagacatgaatataaacatccaagaagttcaatgacagctgatgaactgaaagagacccacatcgagatacactataatcaaactatccaaagtcaaagagaattttgaaaacagtgagggaaaactgatttgtctcatacaaggaattttcaataagattatgggcaaatttatcgtcagaaactttgaaggccagaagtagtggtctgatatatttaaagtgctatttttttcagctgtcaactagaaattttatacgcagaaaaaatattctccaaaagcaagggagaaattaagacattctcagataaacagaagctgaaggagttttttacttgtctttgcagtaaatgctaaagggagtccttcctgcaggttgatataaaaggacactaaacaataacttgatgccatatgaagaaaaaaagatctcagcaaagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaa

SEQ ID NO: 7930 - DNA, 3499 bp, Artificial Sequence
  Synthetic polypeptide
agaggattatgtgtacatggcagaatctatcccgccacctagacaacaattactctttccaagtctgtctgatgtatctattttgggaccctggtgtctaatcaaaattggcaacttccagaaggaggcttggacagtgagttgtacttaatttcagtgagtttcagctcttaacacaatagtggctgcacatcctctacccctagccctgtggcaggctttccagatgtgcatacattccagtagcagcttgtgctcaacgtgcaggggccgaatgggaaaaaatgaaccctgtcctacaaataacagggatctatgttgtgatcactgatgcctgcctctgaacacaaaggtacagacaaagaaatggcaaccatgtgtttgcaactctccctattgttgtaagcacctccccctctggctgaagtgacttccaggggatttaaagagcttgtgccttttcctgtgtctccttcatttttctccttttccctttttgggagccagacattgaagactaagacattcaaaagcaaccacatatatggggtaagttggaaagacattgaacttgcccaggggaaggtgcagcctcagaaaagacctaagaagactcttaagtgtgcagttcaggctgatccttggcaacctacaacaattacaataaacaaacaaaatccagcaaatccttgaggaagggagacaatctgatttccagagttaccatatcattagattcagatatccagttgttagcaaaaaattatgaggcataaaaagaaacaaaaacgtatggcccactcaaaggggaaaacaaagaccaacagaaacagtgcctgatgaagacctgatggcacatctactagacaaagacttttaaaaaaatcttaaagatgcttaaaaaactgaaggaaaatttggagaaagtcaagaaaatggtgtatgcattaaatgaaaatatcaaaaaagagatagaaaacataagaaagaaactaaaaagaaatgcgggagctgaaaagtacaataactgaaatgaaaattttaaaagagggattcaaaggcagatttgagcaggcagaagaaagaatcaacaaacttgtagataagacagtgaaaattatcaagtatgagaaatacaaagaaaaaaatataagaaaagtgatcagagcctaagagacatctgggttaccattaagtggaccagcttactcattgtgggagtcctaaaaggaaaagagagaagggtgcagagagaatatttgaagaaataatgatggaaaacttcccaaatttgatgaaagacatgaatataaacatccaagaagttcaatgacagctgatgaactgaaagagacccacatcgagatacactataatcaaactatccaaagtcaaagagaattttgaaaacagtgagggaaaactgatttgtctcatacaaggaattttcaataagattatgggcaaatttatcgtcagaaactttgaaggccagaagtagtggtctgatatatttaaagtgctatttttttcagctgtcaactagaaattttatacgcagaaaaaatattctccaaaagcaagggagaaattaagacattctcagataaacagaagctgaaggagttttttacttgtctttgcagtaaatgctaaagggagtccttcctgcaggttgatataaaaggacactaaacaataacttgatgccatatgaagaaaaaaagatctcagcaaagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaa

SEQ ID NO: 7931 - DNA, 2098 bp, Artificial Sequence
  Synthetic polypeptide
agaggattatgtgtacatggcagaatctatcccgccacctagacaacaattactctttccaagtctgtctgatgtatctattttgggaccctggtgtctaatcaaaattggcaacttccagaaggaggcttggacagtgagttgtacttaatttcagtgagtttcagctcttaacacaatagtggctgcacatcctctacccctagccctgtggcaggctttccagatgtgcatacattccagtagcagcttgtgctcaacgtgcaggggccgaatgggaaaaaatgaaccctgtcctacaaataacagggatctatgttgtgatcactgatgcctgcctctgaacacaaaggtacagacaaagaaatggcaaccatgtgtttgcaactctccctattgttgtaagcacctccccctctggctgaagtgacttccaggggatttaaagagcttgtgccttttcctgtgtctccttcatttttctccttttccctttttgggagccagacattgaagactaagacattcaaaagcaaccacatatatggggtaagttggaaagacattgaacttgcccaggggaaggtgcagcctcagaaaagacctaagaagactcttaagtgtgcagttcaggctgatccttggcaacctacaacaattacaataaacaaacaaaatccagcaaatccttgaggaagggagacaatctgatttccagagttaccatatcattagattcagatatccagttgttagcaaaaaattatgaggcataaaaagaaacaaaaacgtatggcccactcaaaggggaaaacaaagaccaacagaaacagtgcctgatgaagacctgatggcacatctactagacaaagacttttaaaaaaatcttaaagatgcttaaaaaactgaaggaaaatttggagaaagtcaagaaaatggtgtatgcattaaatgaaaatatcaaaaaagagatagaaaacataagaaagaaactaaaaagaaatgcgggagctgaaaagtacaataactgaaatgaaaattttaaaagagggattcaaaggcagatttgagcaggcagaagaaagaatcaacaaacttgtagataagacagtgaaaattatcaagtatgagaaatacaaagaaaaaaatataagaaaagtgatcagagcctaagagacatctgggttaccattaagtggaccagcttactcattgtgggagtcctaaaaggaaaagagagaagggtgcagagagaatatttgaagaaataatgatggaaaacttcccaaatttgatgaaagacatgaatataaacatccaagaagttcaatgacagctgatgaactgaaagagacccacatcgagatacactataatcaaactatccaaagtcaaagagaattttgaaaacagtgagggaaaactgatttgtctcatacaaggaattttcaataagattatgggcaaatttatcgtcagaaactttgaaggccagaagtagtggtctgatatatttaaagtgctatttttttcagctgtcaactagaaattttatacgcagaaaaaatattctccaaaagcaagggagaaattaagacattctcagataaacagaagctgaaggagttttttacttgtctttgcagtaaatgctaaagggagtccttcctgcaggttgatataaaaggacactaaacaataacttgatgccatatgaagaaaaaaagatctcagcaaagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtga

SEQ ID NO: 7932 - DNA, 1957 bp, Artificial Sequence
  Synthetic polypeptide
agaggattatgtgtacatggcagaatctatcccgccacctagacaacaattactctttccaagtctgtctgatgtatctattttgggaccctggtgtctaatcaaaattggcaacttccagaaggaggcttggacagtgagttgtacttaatttcagtgagtttcagctcttaacacaatagtggctgcacatcctctacccctagccctgtggcaggctttccagatgtgcatacattccagtagcagcttgtgctcaacgtgcaggggccgaatgggaaaaaatgaaccctgtcctacaaataacagggatctatgttgtgatcactgatgcctgcctctgaacacaaaggtacagacaaagaaatggcaaccatgtgtttgcaactctccctattgttgtaagcacctccccctctggctgaagtgacttccaggggatttaaagagcttgtgccttttcctgtgtctccttcatttttctccttttccctttttgggagccagacattgaagactaagacattcaaaagcaaccacatatatggggtaagttggaaagacattgaacttgcccaggggaaggtgcagcctcagaaaagacctaagaagactcttaagtgtgcagttcaggctgatccttggcaacctacaacaattacaataaacaaacaaaatccagcaaatccttgaggaagggagacaatctgatttccagagttaccatatcattagattcagatatccagttgttagcaaaaaattatgaggcataaaaagaaacaaaaacgtatggcccactcaaaggggaaaacaaagaccaacagaaacagtgcctgatgaagacctgatggcacatctactagacaaagacttttaaaaaaatcttaaagatgcttaaaaaactgaaggaaaatttggagaaagtcaagaaaatggtgtatgcattaaatgaaaatatcaaaaaagagatagaaaacataagaaagaaactaaaaagaaatgcgggagctgaaaagtacaataactgaaatgaaaattttaaaagagggattcaaaggcagatttgagcaggcagaagaaagaatcaacaaacttgtagataagacagtgaaaattatcaagtatgagaaatacaaagaaaaaaatataagaaaagtgatcagagcctaagagacatctgggttaccattaagtggaccagcttactcattgtgggagtcctaaaaggaaaagagagaagggtgcagagagaatatttgaagaaataatgatggaaaacttcccaaatttgatgaaagacatgaatataaacatccaagaagttcaatgacagctgatgaactgaaagagacccacatcgagatacactataatcaaactatccaaagtcaaagagaattttgaaaacagtgagggaaaactgatttgtctcatacaaggaattttcaataagattatgggcaaatttatcgtcagaaactttgaaggccagaagtagtggtctgatatatttaaagtgctatttttttcagctgtcaactagaaattttatacgcagaaaaaatattctccaaaagcaagggagaaattaagacattctcagataaacagaagctgaaggagttttttacttgtctttgcagtaaatgctaaagggagtccttcctgcaggttgatataaaaggacactaaacaataacttgatgccatatgaagaaaaaaagatctcagcaaagctcggtcaaggagtgtgatgactggcgagcagatggctgccttccatccatcgtccacccccaacccgctggagaggcccatcaagatgggctggctgaagaagcagaggtccatcgtgaagaactggcagcagagtggtcctccaggaagcaccaggacgggcactgtggagtttcctacacatggctctgagtcaagactggcaacagggcggtga

SEQ ID NO: 7933 - DNA, 3076 bp, Artificial Sequence
  Synthetic polypeptide
agaggattatgtgtacatggcagaatctatcccgccacctagacaacaattactctttccaagtctgtctgatgtatctattttgggaccctggtgtctaatcaaaattggcaacttccagaaggaggcttggacagtgagttgtacttaatttcagtgagtttcagctcttaacacaatagtggctgcacatcctctacccctagccctgtggcaggctttccagatgtgcatacattccagtagcagcttgtgctcaacgtgcaggggccgaatgggaaaaaatgaaccctgtcctacaaataacagggatctatgttgtgatcactgatgcctgcctctgaacacaaaggtacagacaaagaaatggcaaccatgtgtttgcaactctccctattgttgtaagcacctccccctctggctgaagtgacttccaggggatttaaagagcttgtgccttttcctgtgtctccttcatttttctccttttccctttttgggagccagacattgaagactaagacattcaaaagcaaccacatatatggggtaagttggaaagacattgaacttgcccaggggaaggtgcagcctcagaaaagacctaagaagactcttaagtgtgcagttcaggctgatccttggcaacctacaacaattacaataaacaaacaaaatccagcaaatccttgaggaagggagacaatctgatttccagagttaccatatcattagattcagatatccagttgttagcaaaaaattatgaggcataaaaagaaacaaaaacgtatggcccactcaaaggggaaaacaaagaccaacagaaacagtgcctgatgaagacctgatggcacatctactagacaaagacttttaaaaaaatcttaaagatgcttaaaaaactgaaggaaaatttggagaaagtcaagaaaatggtgtatgcattaaatgaaaatatcaaaaaagagatagaaaacataagaaagaaactaaaaagaaatgcgggagctgaaaagtacaataactgaaatgaaaattttaaaagagggattcaaaggcagatttgagcaggcagaagaaagaatcaacaaacttgtagataagacagtgaaaattatcaagtatgagaaatacaaagaaaaaaatataagaaaagtgatcagagcctaagagacatctgggttaccattaagtggaccagcttactcattgtgggagtcctaaaaggaaaagagagaagggtgcagagagaatatttgaagaaataatgatggaaaacttcccaaatttgatgaaagacatgaatataaacatccaagaagttcaatgacagctgatgaactgaaagagacccacatcgagatacactataatcaaactatccaaagtcaaagagaattttgaaaacagtgagggaaaactgatttgtctcatacaaggaattttcaataagattatgggcaaatttatcgtcagaaactttgaaggccagaagtagtggtctgatatatttaaagtgctatttttttcagctgtcaactagaaattttatacgcagaaaaaatattctccaaaagcaagggagaaattaagacattctcagataaacagaagctgaaggagttttttacttgtctttgcagtaaatgctaaagggagtccttcctgcaggttgatataaaaggacactaaacaataacttgatgccatatgaagaaaaaaagatctcagcaaagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatggtaaggtgcagagaaccttcctgcttccattgggttcttcctttagtccaggccatcccatgtaaggcctgctctcgggtggcaatttggggagttttaggtgatgcagtggcagtgggcgctgctgctacagactcatctgaacacaccttgaaagcctggcctctttccaaatctagtttctattggcatctttga

SEQ ID NO: 7934 - DNA, 2672 bp, Artificial Sequence; identical to SEQ ID NO: 6621
  Synthetic polypeptide

SEQ ID NO: 7935 - DNA, 1767 bp, Artificial Sequence; identical to SEQ ID NO: 6622
  Synthetic polypeptide

SEQ ID NO: 7936 - DNA, 1692 bp, Artificial Sequence; identical to SEQ ID NO: 6623
  Synthetic polypeptide

SEQ ID NO: 7937 - DNA, 2448 bp, Artificial Sequence; identical to SEQ ID NO: 6618
  Synthetic polypeptide

SEQ ID NO: 7938 - DNA, 1543 bp, Artificial Sequence; identical to SEQ ID NO: 6619
  Synthetic polypeptide

SEQ ID NO: 7939 - DNA, 1468 bp, Artificial Sequence; identical to SEQ ID NO: 6620
  Synthetic polypeptide

SEQ ID NO: 7940 - DNA, 1848 bp, Artificial Sequence
  Synthetic polypeptide
gatataatagaagaaaattttcctgatatgagggaagaactaactttgcagatcaaaaggggacaatgtgtacaacaggaaaaattgatacatcataatgggaataggcacttagttaaattaattgaacttcaaatataaagagttgtgcatagacagaaaaatcaagaagtacaaacttaagcttgcctcagacttttcaataggaacatctaacaccaggaaacagtggagcagtatcattgagagaatggaaatgtaaacaaagaatattgcatccagccaagttaatactcaagtacaaaggcaacaggcagacatccttaaatacaaatgaaatcataagctgttcttgtaaaatcaagttaacgaaatttatccaagcaagatagaagttcaaataaacacgcagatggaagaaggcataataaaggtctcttgttgaggtttcaatccattttatatccagaatgaagactaaaaatttggcaattataaccacagaacagattggaaaattgaaattttaaccaagtaaaaatagtaatataatctgcaaaaaccaggaggtgggattgagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtga

SEQ ID NO: 7941 - DNA, 382 bp, Artificial Sequence; identical to SEQ ID NO: 434
  Synthetic polypeptide

SEQ ID NO: 7942 - DNA, 187 bp, Artificial Sequence
  Synthetic polypeptide
ggtgctgtggagacagtatggacttcggcgtcatccagagctgagagttcccacagtctgattctgcctttatatggaatctgaatttctgtgtttggaatttgatgaggtcaaagtcaaccaaattctgaagacgctgtcagaggtagaagaaagtatcagcacactgatcagccagcctaactga

SEQ ID NO: 7943 - DNA, 629 bp, Artificial Sequence
  Synthetic polypeptide
acaccacgaagaagcagttaaatacagaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtcgtttttcccttggatattgtgattttgatttaagaccatgtcatgaaacaacagtagacatttttcataagaagcatacaaaaaatatatga

SEQ ID NO: 7944 - DNA, 472 bp, Artificial Sequence
  Synthetic polypeptide
acaccacgaagaagcagttaaatacagaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtcgtttttcccttggatattgtga

SEQ ID NO: 7945 - DNA, 559 bp, Artificial Sequence
  Synthetic polypeptide
cactgtggttagggcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtga

SEQ ID NO: 7946 - DNA, 622 bp, Artificial Sequence
  Synthetic polypeptide
cactgtggttagggcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagctgctgctacagctgaggcctggatcccggcctttccctgtgacttacgtgtctgtcaccggcaggcagccctacaaatcctggtga

SEQ ID NO: 7947 - DNA, 429 bp, Artificial Sequence
  Synthetic polypeptide
cactgtggttagggcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgc

SEQ ID NO: 7948 - DNA, 377 bp, Artificial Sequence
  Synthetic polypeptide
cactgtggttagggcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtt

SEQ ID NO: 7949 - DNA, 176 bp, Artificial Sequence
  Synthetic polypeptide
cactgtggttagggcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactccc

SEQ ID NO: 7950 - DNA, 2333 bp, Artificial Sequence
  Synthetic polypeptide
catttagactcacaagactactgtaggctacacttggcagcagtctcctcggaaggatatgggatagggaccacagcagggtagcatcaggcaggtgtcttctgtgggagccctttcagcagtcatgcagtaattcagagttctcttcttcagcccgccagagacagctcaggtgcaaggagatgagactatacatcaggcaggtgaccttagagcaagactccagaatgaaattcctaaagcttttaggatacagtaaagatgagcttcagaagaaggtggccacatggttgaagagtgacgtggggctaggtgagagtcctcagcccaagggaaatgacctcaacagtgacagacaacaggccttctgcagccaggcctccaaacacaccacaaaggaagcctctgcttcctcagccttctttgatgagctggtccctcagaacatgactccttgggagatccccatcacaaaagatattgatggactcctaagccaggctctcctgcttggggaactgggtccggccgtggagctgtgtctgaaggaggagcgctttgctgatgccattatcctggcccaggctgggggtacagatctgctgaagcaaacacaggagcgctacttggccaagaagaaaaccaaaatctcctcgcttctagcctgtgttgtgcaaaagaattggaaggatgtggtgtgtacctgtagcctgaagaactggagagaggcactggctttgctactgacatactcaggcacagagaaatttcccgagctctgtgacatgctgggaactcgcatggaacaggagggcagcagggcactaacctccgaagccagactctgttatgtgtgctcagggagtgtggagcggctggtggagtgctgggcaaaatgccaccaggctttgtcccccatggctctgcaggacctgatggagaaggtgatggttcttaacaggagcttggagcaactgcggggtcctcatggggtgagcccaggccctgccacaacctacagggtcactcagtatgccaacctcctggcagcccagggcagcctggccactgccatgagctttctacccagggactgtgctcagccaccagttcagcagctaagagatcggctttttcatgctcaaggttctgctgtcttgggccaacagtctccccctttccccttcccccggattgttgtgggagctaccctccactctaaagagacatcatcttacagattgggatcccagccttctcaccaggtcccaactccatctccaaggccaagggttttcacccctcagtcatcaccagcgatgcccttggcaccttcccatcctagcccttatcagggtcccaggacacagaatataagtgactacagggcacctgggccccaggccatccagcctttgcctttgagccctggggtaaggcctgcttcatctcagccacagctattaggagggcaaagggtgcaagttcctaacccggtgggattccctgggacatggcctcttcctggttcccctctacccatggcatgcccaggcatcatgcgacctggctctacctccctgcctgagactcctagactgttccctctgcttcctctgagaccactaggtcccggccgcatggtctcccacaccccagcccctcctgcaagcttccctgtgccataccttccaggggacccaggtgccccatgctctagtgtcctcccaaccactggcatcttgactcctcacccaggacctcaagattcctggaaagaagccccagcccccaggggaaacctccagaggaacaagctgccagagacatttatgcccccagcaccaattactgctccagttatgagcctcacccctgagctacaagggattcttccctcacagccccctgtctccagtgtgagtcatgctcccccaggagttccaggagaactcagcctgcagcttcagcacctgccacctgagaagatggaaaggaaggagctgcccccagagcatcagtccttgaagagcagctttgaggcgcttctccaacgctgctccctgtctgcaactgacttaaagacaaaaaggaagctggaagaggcagcccagcgtctggagtatctatatgagaagctctgtgaggggacactctcacctcatgtcgtggctgggctccatgaggttgcccgatgtgtggatgcaggaagctttgagcagggccttgcagtgcatgcccaggtggcgggctgtagcagcttcagcgaggtgtccagcttcatgcctatcctgaaggctgtcctcatcatcgctcataagctgctggtctaa

SEQ ID NO: 7951 - DNA, 361 bp, Artificial Sequence
  Synthetic polypeptide
ggccgggccctgtggctcactcctgtaatcccagcactttgggaggctgaggcaggcggatcacgagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaa

SEQ ID NO: 7952 - DNA, 340 bp, Artificial Sequence
  Synthetic polypeptide
ggccgggccctgtggctcactcctgtaatcccagcactttgggaggctgaggcaggcggatcacgagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggtaataggtcaacattttatcatggaaaggttcagccacagtgagagtggattttag

SEQ ID NO: 7953 - DNA, 393 bp, Artificial Sequence
  Synthetic polypeptide
ggccgggccctgtggctcactcctgtaatcccagcactttgggaggctgaggcaggcggatcacgaggtcaggagatcgagaccatcctggctgacacgaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaa

SEQ ID NO: 7954 - DNA, 372 bp, Artificial Sequence
  Synthetic polypeptide
ggccgggccctgtggctcactcctgtaatcccagcactttgggaggctgaggcaggcggatcacgaggtcaggagatcgagaccatcctggctgacacgaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggtaataggtcaacattttatcatggaaaggttcagccacagtgagagtggattttag

SEQ ID NO: 7955 - DNA, 956 bp, Artificial Sequence; identical to SEQ ID NO: 7135
  Synthetic polypeptide

SEQ ID NO: 7956 - DNA, 1360 bp, Artificial Sequence
  Synthetic polypeptide
ctggttcttttccttccagatccctaaagaagtggctgacatctttaacgcccccagtgatgatgaagagtttgttggcttccgagatgatgttcccatggaaaccctctcgtcagaggagagctgcgatagttttgactcactagagtcagggaaacagcaggatgtgcgctttcattccaaatacttcacagaagagctaagaagaatttttatagaggacactgactcagagactgaggattttgcaggatttacgcagagtgatctgaatggaaagactaacccagaagtaatggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatgcttgcccagttattggcggaattgaactcgatgccagatttcttcccagtacgaaccccaacctcagcttctaggaagaagacagtgaggcgggccttctcggagggacagatcacgcggcgtatgaacccaacccggagtgcgcggcctcctgagaagtttgctctagagaacttcactgtctcagccgctaaatttgcggaagagttttacagcttccgaagaaggaagacaattggggggaaatgccgggagtacagacgacgtcaccgtatatcttcttttcggccagtggaggatatcaccgaagaggacttagaaaatgttgccataactgttcgagataaaatctatgataaagttctgggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagcttacaaaaggagctggtagaagacaattaa

SEQ ID NO: 7957 - DNA, 1222 bp, Artificial Sequence
  Synthetic polypeptide
ctggttcttttccttccagatccctaaagaagtggctgacatctttaacgcccccagtgatgatgaagagtttgttggcttccgagatgatgttcccatggaaaccctctcgtcagaggagagctgcgatagttttgactcactagagtcagggaaacaggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatgcttgcccagttattggcggaattgaactcgatgccagatttcttcccagtacgaaccccaacctcagcttctaggaagaagacagtgaggcgggccttctcggagggacagatcacgcggcgtatgaacccaacccggagtgcgcggcctcctgagaagtttgctctagagaacttcactgtctcagccgctaaatttgcggaagagttttacagcttccgaagaaggaagacaattggggggaaatgccgggagtacagacgacgtcaccgtatatcttcttttcggccagtggaggatatcaccgaagaggacttagaaaatgttgccataactgttcgagataaaatctatgataaagttctgggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagcttacaaaaggagctggtagaagacaattaa

SEQ ID NO: 7958 - DNA, 527 bp, Artificial Sequence
  Synthetic polypeptide
caagttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagttagtcatgaaagaagatggtgccaacttgtatgttgcaaaggtttcacaagttcctcgaatgaatccaagacctgtcatggtttcctatcctgggagcaggagagtgtgcctatttgaatga

SEQ ID NO: 7959 - DNA, 518 bp, Artificial Sequence
  Synthetic polypeptide
caagttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagtttcctatcctgggagcaggagagtgtgcctatttgaatgacaaaggtgccagtagtgccaggcactacacagagaggaagtggatttgttccaaatcagatatacatgtctag

SEQ ID NO: 7960 - DNA, 311 bp, Artificial Sequence
  Synthetic polypeptide
caagttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtaagaaaatag

SEQ ID NO: 7961 - DNA, 45 bp, Artificial Sequence
  Synthetic polypeptide
caagttgtctgcattcaaaagagcattctattaaagctaccttaa

SEQ ID NO: 7962 - DNA, 407 bp, Artificial Sequence
  Synthetic polypeptide
caagttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagtaa

SEQ ID NO: 7963 - DNA, 341 bp, Artificial Sequence
  Synthetic polypeptide
caagttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtttcctatcctgggagcaggagagtgtgcctatttgaatga

SEQ ID NO: 7964 - DNA, 854 bp, Artificial Sequence
  Synthetic polypeptide
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagaaagacacaccgacctggaccaagggagacaggcataaacagctccaaagggaaacacacgggaaaaagagagaacaagagaaagaaatagacgccctgaaagaagagacagagacttatgagccgtag

SEQ ID NO: 7965 - DNA, 749 bp, Artificial Sequence
  Synthetic polypeptide
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggtcctcggcagcctgatcttctgcttcggcatctggatcctcattgacaagaccagcttcgtgtcctttgcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtag

SEQ ID NO: 7966 - DNA, 1229 bp, Artificial Sequence
  Synthetic polypeptide
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttag

SEQ ID NO: 7967 - DNA, 1196 bp, Artificial Sequence
  Synthetic polypeptide
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgaggtgatctggccccgcccccacccgcgatcggccctaaatccctag

SEQ ID NO: 7968 - DNA, 865 bp, Artificial Sequence
  Synthetic polypeptide
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggtcctcggcagcctgatcttctgcttcggcatctggatcctcattgacaagaccagcttcgtgtcctttgtgggcaggctacaggctcccatccactgctcaccggaggcttcttggagcctgagtcttcttccggcaaatggggttgtgcatacaaacaacaatgatcatgagagccatttctcaagcacttcctatctgtcgggacttgtggctggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggc

SEQ ID NO: 7969 - DNA, 1271 bp, Artificial Sequence
  Synthetic polypeptide
gaaagtcagaatttgtatcttgtctgtgcttgttatgagctaggtaacctaggaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaa

SEQ ID NO: 7970 - DNA, 69 bp, Artificial Sequence
  Synthetic polypeptide
gaaagtcagaatttgtatcttgtctgtgcttgttatgagctaggtaacctaggaaggagcgatatatag

SEQ ID NO: 7971 - DNA, 738 bp, Artificial Sequence
  Synthetic polypeptide
ctcaacactgcatggcttcccttagaacctttgcccaattctgaagctgtgggtggaagatgagaagccacacagagagcctccgaataacataggagcctcttggccatcttgaggtgctgatgagatgaggatcggcctgaccctcgagcccagcagagcagggcagcccagaagcagatgacactgtcccaaatgtgtggccaccctggagtcagctcagtccctgcacggtccaggggatccccctctactcggtctgcctggcggagcaaagggtgagccctctagaggaaaatgtcgccatcctagacctctgcagtctttcctatgcgttcagcaacagtttaccgggcatgccacgagacaggaccacagcaccgaaaaccacgagaaaaaaagagcagtagagccacagtgggagaggccgatgttatcagataaggagcctaaaataaggggaaaaaggaaaaattggagcatttcgccagagatgcagcttcagctgccctcgcagatgccgctgaggagctgctggaccgccttgcgtcacacagcatgctgccctcagacgtgtccatcctgtaccacatgaaaacgctgctgctcctgcaagatactgagagattgaagcatgctctggaaatgttcccagaacattgcacgatgcctcctggagtcctaagcagacttaaagccaagaaaataagaagaggaaagagagaggggctgccttaa

SEQ ID NO: 7972 - DNA, 816 bp, Artificial Sequence
  Synthetic polypeptide
ctcaacactgcatggcttcccttagaacctttgcccaattctgaagctgtgggtggaagatgagaagccacacagagagcctccgaataacataggagcctcttggccatcttgaggtgctgatgagatgaggatcggcctgaccctcgagcccagcagagcagggcagcccagaagcagatgacactgtcccaaatgtgtggccaccctggagtcagctcagtccctgcacggtccaggggatccccctctactcggtctgcctggcggagcaaagggtgagccctctagaggaaaatgtcgccatcctagacctctgcagtctttcctatgcgttcagcaacagtttaccgggcatgccacgagacaggaccacagcaccgaaaaccacgagaaaaaaagagcagtagagccacagtgggagaggccgatgttatcagataaggagcctaaaataaggggaaaaaggaaaaattggagcatttcgccagagatgcagcttcagctgccctcgcagatgccgctgaggagctgctggaccgccttgcgtcacacagcatgctgccctcagacgtgtccatcctgtaccacatgaaaacgctgctgctcctgcaagatactgagagattgaagcatgctctggaaatgttcccagaacattgcacgatgcctcctggtgggaagtctgaagctcagagagcctgggccaatggtacaggtcacacagcacatcagtggctacatgtgagctcagacctgggtctgctgctgtctgtcttcccaatatccatgaccttgactgatgcaggtgtctag

SEQ ID NO: 7973 - DNA, 750 bp, Artificial Sequence
  Synthetic polypeptide
ctcaacactgcatggcttcccttagaacctttgcccaattctgaagctgtgggtggaagatgagaagccacacagagagcctccgaataacataggagcctcttggccatcttgaggtgctgatgagatgaggatcggcctgaccctcgagcccagcagagcagggcagcccagaagcagatgacactgtcccaaatgtgtggccaccctggagtcagctcagtccctgcacggtccaggggatccccctctactcggtctgcctggcggagcaaagggtgagccctctagaggaaaatgtcgccatcctagacctctgcagtctttcctatgcgttcagcaacagtttaccgggcatgccacgagacaggaccacagcaccgaaaaccacgagaaaaaaagagcagtagagccacagtgggagaggccgatgttatcagataaggagcctaaaataaggggaaaaaggaaaaattggagcatttcgccagagatgcagcttcagctgccctcgcagatgccgctgaggagctgctggaccgccttgcgtcacacagcatgctgccctcagacgtgtccatcctgtaccacatgaaaacgctgctgctcctgcaagatactgagagattgaagcatgctctggaaatgttcccagaacattgcacgatgcctcctgaccatgccagagtaatctcagctttctttagttactggatcacacatatccttcctgagaagagcagtgactaa

SEQ ID NO: 7974 - DNA, 783 bp, Artificial Sequence
  Synthetic polypeptide
ctcaacactgcatggcttcccttagaacctttgcccaattctgaagctgtgggtggaagatgagaagccacacagagagcctccgaataacataggagcctcttggccatcttgaggtgctgatgagatgaggatcggcctgaccctcgagcccagcagagcagggcagcccagaagcagatgacactgtcccaaatgtgtggccaccctggagtcagctcagtccctgcacggtccaggggatccccctctactcggtctgcctggcggagcaaagggtgagccctctagaggaaaatgtcgccatcctagacctctgcagtctttcctatgcgttcagcaacagtttaccgggcatgccacgagacaggaccacagcaccgaaaaccacgagaaaaaaagagcagtagagccacagtgggagaggccgatgttatcagataaggagcctaaaataaggggaaaaaggaaaaattggagcatttcgccagagatgcagcttcagctgccctcgcagatgccgctgaggagctgctggaccgccttgcgtcacacagcatgctgccctcagacgtgtccatcctgtaccacatgaaaacgctgctgctcctgcaagatactgagagattgaagcatgctctggaaatgttcccagaacattgcacgatgcctcctggtaagtaccgtacgatttattcaaggtcctgcttaagatactctcatcgaggtttgcctctgaaagacttacacgccaccaaaacagcaatgagttggaaaatatga

SEQ ID NO: 7975 - DNA, 3050 bp, Artificial Sequence
  Synthetic polypeptide
tgacatggtttggctgtgtccctacccaaatctcatcttgaatcgtagttctcataatccccacgtgtcatgggagggacctagggggaggtaatttaatcatggggacagttaccctcatgctgttcttgtgacagtgggtgagttctcacgagatctgacagttttatgaggggcttttccctgcttcactctgcacttctcctcgccgccgccatatgaaggacgtgtttgcttccccttctgccgtaattgtaagtttcctgaggcctccccagccatgctgaactatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcccgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggaaacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctga

SEQ ID NO: 7976 - DNA, 745 bp, Artificial Sequence
  Synthetic polypeptide
tgacatggtttggctgtgtccctacccaaatctcatcttgaatcgtagttctcataatccccacgtgtcatgggagggacctagggggaggtaatttaatcatggggacagttaccctcatgctgttcttgtgacagtgggtgagttctcacgagatctgacagttttatgaggggcttttccctgcttcactctgcacttctcctcgccgccgccatatgaaggacgtgtttgcttccccttctgccgtaattgtaagtttcctgaggcctccccagccatgctgaactatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcc

SEQ ID NO: 7977 - DNA, 362 bp, Artificial Sequence
  Synthetic polypeptide
gagcacgaggtaagactcggaccaaggacaagtaccgcgtggtctacaccgaccaccaacgcctggagctggagaaggagtttcattacagccgttacatcacaatccggcggaaatcagagctggctgccaatctggggctcactgaacggcaggtgaagatctggttccaaaaccggcgggcaaaggagcgcaaagtgaacaagaagaaacagcagcagcaacagcccccacagccgccgatggcccacgacatcacggccaccccagccgggccatccctggggggcctgtgtcccagcaacaccagcctcctggccacctcctctccaatgcctgtgaaagaggagtttctgccatag

SEQ ID NO: 7978 - DNA, 254 bp, Artificial Sequence; identical to SEQ ID NO: 6870
  Synthetic polypeptide

SEQ ID NO: 7979 - DNA, 415 bp, Artificial Sequence; identical to SEQ ID NO: 6871
  Synthetic polypeptide

SEQ ID NO: 7980 - DNA, 580 bp, Artificial Sequence; identical to SEQ ID NO: 6872
  Synthetic polypeptide

SEQ ID NO: 7981 - DNA, 1249 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataa

SEQ ID NO: 7982 - DNA, 472 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcaggatgataacaccctatgcccattgtcctgatctgaaaattcttggaaattgttccatgtga

SEQ ID NO: 7983 - DNA, 1195 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctatag

SEQ ID NO: 7984 - DNA, 709 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagaaaacgcccactcctggatcttcacattgaactcaatggctacatgtatgattggaacagcagagtttctgccaaggagaaatattatgtctggctgcagcacactctga

SEQ ID NO: 7985 - DNA, 1144 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcaggagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataa

SEQ ID NO: 7986 - DNA, 685 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacaggttggagtgcaatggcgcaatctcagctcaccgcaatctccacctcccaggttcaagcgattctcctgcctcagcctcctgagtaa

SEQ ID NO: 7987 - DNA, 538 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcagggctggagtgcaatggcgcgatcttggctcaccgcaacctccgcctcccgggttcaagcgattctcccacctcagcctcccaagtagctgggattacaggaatgtgccaccacgcccggctccataa

SEQ ID NO: 7988 - DNA, 446 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcaggatgataacaccctatgcccattgtcctgatctga

SEQ ID NO: 7989 - DNA, 599 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacag

SEQ ID NO: 7990 - DNA, 448 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccagttcaaggagcagggacaagttacaggaatgttctccaagcagcaatccaaaagagtctcaaggatccttcaaataacttcagggtgagtctggagaaaacatatggaatcccagcatga

SEQ ID NO: 7991 - DNA, 220 bp, Artificial Sequence
  Synthetic polypeptide
ttagtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctga

SEQ ID NO: 7992 - DNA, 334 bp, Artificial Sequence
  Synthetic polypeptide
ttagtcatctggggacctggagaatgatgagcaggcagccagtgccatctctgagctggtcagcacagcctgcggtttccggctgcaccgcggcatgaatgtgcccttcaagcgcctgtctggtgagcccctgcccctgcccttggtggtggtactgggagcggggggctacttccaggggcttctcggcttctcttcttccagcctcctaccatctcctggggtctctggtctggccactttcctccctttgggactccctggtatcagaattgtgaatgagaaggcaagagaaaggagatctagcagaggccactcatcttcaaatctctga

SEQ ID NO: 7993 - DNA, 287 bp, Artificial Sequence
  Synthetic polypeptide
gtgaccttggataaggcacacttagcctcagctttttcctctacaagtgttgctttctcatagggcgaaattcttcagacgagatacttaagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgggaacaaggacagggggatttaa

SEQ ID NO: 7994 - DNA, 914 bp, Artificial Sequence
  Synthetic polypeptide
gtgaccttggataaggcacacttagcctcagctttttcctctacaagtgttgctttctcatagggcgaaattcttcagacgagatacttaagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggccgaatccgggtgcatggtattggcgggggccacaagcaacgttatcgaatgattgactttctgcgtttccggcctgaggagaccaagtcaggaccctttgaggagaaggttatccaagtccgctatgatccctgtaggtcagcagacatagctctggttgctgggggcagccggaaacgctggatcatcgccacagaaaacatgcaggctggagatacaatcttgaactctaaccacataggccgaatggcagttgctgctcgggaaggggatgcgcatcctcttggggctctgcctgtggggaccctcatcaacaacgtggaaagtgagccaggccggggtgcccaatatatccgagctgcagggacgtgtggtgtgctactgcggaaggtgaatggcacagccattatccagctgccctctaagaggcagatgcaggtgctggaaacgtgcgtagcaacagtaggccgagtatccaacgttgatcataacaaacgggtcattggcaaggcaggtcgcaaccgctggctgggcaagaggcctaacagtgggcggtggcaccgcaaggggggctgggctggccgaaagattcggccactaccccccatgaagagttacgtgaagctgccttctgcttctgcccaaagctga

SEQ ID NO: 7995 - DNA, 674 bp, Artificial Sequence
  Synthetic polypeptide
gtgaccttggataaggcacacttagcctcagctttttcctctacaagtgttgctttctcatagggcgaaattcttcagacgagatacttaagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggccgaatccgggtgcatggtattggcgggggccacaagcaacgttatcgaatgattgactttctgcgtttccggcctgaggagaccaagtcaggaccctttgaggagaaggttatccaagtccgctatgatccctgtaggtcagcagacatagctctggttgctgggggcagccggaaacgctggatcatcgccacagaaaacatgcaggctggagatacaatcttgaactctaaccacataggccgaatggcagttgctgctcgggaaggggatgcgcatcctcttggggctctgcctgtggggaccctcatcaacaacgtggaaagtgagccaggccggggtgcccaatatatccgagctgcaggtgctggaaacgtgcgtagcaacagtaggccgagtatccaacgttga

SEQ ID NO: 7996 - DNA, 308 bp, Artificial Sequence
  Synthetic polypeptide
gtgaccttggataaggcacacttagcctcagctttttcctctacaagtgttgctttctcatagggcgaaattcttcagacgagatacttaagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgctggaaacgtgcgtagcaacagtaggccgagtatccaacgttga

SEQ ID NO: 7997 - DNA, 175 bp, Artificial Sequence
  Synthetic polypeptide
gtgaccttggataaggcacacttagcctcagctttttcctctacaagtgttgctttctcatagggcgaaattcttcagacgagatacttaagatgatgaacaatggcctcctccaacagccctctgccttgatgttgctcccctgccgcccagttcttacttctgtggcccttaa

SEQ ID NO: 7998 - DNA, 247 bp, Artificial Sequence
  Synthetic polypeptide
aatgagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaaggtacagtttactgttgcagacttttggacaaagtccttttcttggctgttataa

SEQ ID NO: 7999 - DNA, 430 bp, Artificial Sequence
  Synthetic polypeptide
aatgagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctgtgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataa

SEQ ID NO: 8000 - DNA, 330 bp, Artificial Sequence; identical to SEQ ID NO: 7604
  Synthetic polypeptide

SEQ ID NO: 8001 - DNA, 181 bp, Artificial Sequence; identical to SEQ ID NO: 7564
  Synthetic polypeptide

SEQ ID NO: 8002 - DNA, 543 bp, Artificial Sequence; identical to SEQ ID NO: 6496
  Synthetic polypeptide

SEQ ID NO: 8003 - DNA, 378 bp, Artificial Sequence; identical to SEQ ID NO: 6497
  Synthetic polypeptide

SEQ ID NO: 8004 - DNA, 267 bp, Artificial Sequence; identical to SEQ ID NO: 6498
  Synthetic polypeptide

SEQ ID NO: 8005 - DNA, 416 bp, Artificial Sequence; identical to SEQ ID NO: 6499
  Synthetic polypeptide

SEQ ID NO: 8006 - DNA, 162 bp, Artificial Sequence; identical to SEQ ID NO: 6500
  Synthetic polypeptide

SEQ ID NO: 8007 - DNA, 147 bp, Artificial Sequence; identical to SEQ ID NO: 6327
  Synthetic polypeptide

SEQ ID NO: 8008 - DNA, 815 bp, Artificial Sequence
  Synthetic polypeptide
ttattgtccttgtccttgttgtcatcagattctaagcttcatggcactggggacttgagactcgttcagcgttttctctctagtatcttaaacagcggcaagtcatgcgtgacccgacataggtgctagggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagaaaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctga

SEQ ID NO: 8009 - DNA, 512 bp, Artificial Sequence
  Synthetic polypeptide
ttattgtccttgtccttgttgtcatcagattctaagcttcatggcactggggacttgagactcgttcagcgttttctctctagtatcttaaacagcggcaagtcatgcgtgacccgacataggtgctagggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaattttaa

SEQ ID NO: 8010 - DNA, 1543 bp, Artificial Sequence
  Synthetic polypeptide
gagtgggcctgggaagtagaagcccccaggattcattcctgctccatcctattctagctgtgggacttggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtga

SEQ ID NO: 8011 - DNA, 772 bp, Artificial Sequence
  Synthetic polypeptide
gagtgggcctgggaagtagaagcccccaggattcattcctgctccatcctattctagctgtgggacttggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggtgagttcaggacatctcgggagcacccccaccccttcaccactacccttggccccctccttgtgttccaaagccaccaccacaggacaggactttctgcagactggtctcttctaacaggctggatgtccttggggggcccatcctgtcccgagccaacatag

SEQ ID NO: 8012 - DNA, 608 bp, Artificial Sequence
  Synthetic polypeptide
gagtgggcctgggaagtagaagcccccaggattcattcctgctccatcctattctagctgtgggacttggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatg

SEQ ID NO: 8013 - DNA, 535 bp, Artificial Sequence
  Synthetic polypeptide
gagtgggcctgggaagtagaagcccccaggattcattcctgctccatcctattctagctgtgggacttggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccc

SEQ ID NO: 8014 - DNA, 454 bp, Artificial Sequence
  Synthetic polypeptide
gagtgggcctgggaagtagaagcccccaggattcattcctgctccatcctattctagctgtgggacttggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgca

SEQ ID NO: 8015 - DNA, 280 bp, Artificial Sequence
  Synthetic polypeptide
gagtgggcctgggaagtagaagcccccaggattcattcctgctccatcctattctagctgtgggacttggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttgga

SEQ ID NO: 8016 - DNA, 441 bp, Artificial Sequence
  Synthetic polypeptide
ctgggcacggttggctcatgcttgtaatcccaacattttgggaggttgagcattggcgctctcataggcctgtccgtagcagcagtggttcttctcgccttcattgttaccgcctgtgtgctctgctacctgttcatcagctctaagccccacacaaagttggacctgggcttgagcttacagacagcaggccctgaggaggtttctcctgactgccaaggtgtgaacacaggcatggcggcagaagtgccaaaagtgagccctctccagcagagttactcctgcttgaacccgcagctggagagcaatgaggggcaggctgtgaactccaaacgcctcctccatcattgcttcatggccacagtgaccaccagtgacattccaggcagccctgaggaagcctctgtacccaaccctgacctatgtggaccagtcccataa

SEQ ID NO: 8017 - DNA, 2851 bp, Artificial Sequence
  Synthetic polypeptide
ggccgggcacggtggctcacacctatcatcccagcactttgggaagcaaagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttga

SEQ ID NO: 8018 - DNA, 2764 bp, Artificial Sequence
  Synthetic polypeptide
ggccgggcacggtggctcacacctatcatcccagcactttgggaagcaaagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggtctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttga

SEQ ID NO: 8019 - DNA, 1906 bp, Artificial Sequence
  Synthetic polypeptide
ggccgggcacggtggctcacacctatcatcccagcactttgggaagcaaagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcgcattcagagctcccaagacccagggcggctcctgcctgacctgttgccctttgacccccaccaggctgacctccagctgtgtgagcaccgagggcctcgcccacctggcatctggtctgggccactgccaccacttggaggagctggacttgtctaa

SEQ ID NO: 8020 - DNA, 1534 bp, Artificial Sequence
  Synthetic polypeptide
ggccgggcacggtggctcacacctatcatcccagcactttgggaagcaaagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtgggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagagactccacaaggcacacagagaaactgtccttccccacactggaggcctgtgctttgggatttaagaaaaaaagaaagaaagaaagaaagaaggtttcagaggatactgaactgaggacaaaaataaactga

SEQ ID NO: 8021 - DNA, 1240 bp, Artificial Sequence
  Synthetic polypeptide
ggccgggcacggtggctcacacctatcatcccagcactttgggaagcaaagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaagtgcctaggaagctggcatgtctgggcaccgtgcttccccaggcccttctctctgcagcctgggctctga

SEQ ID NO: 8022 - DNA, 1385 bp, Artificial Sequence
  Synthetic polypeptide
ggccgggcacggtggctcacacctatcatcccagcactttgggaagcaaagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtgggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagagactccacaaggcacacagagaaactgtccttccccacactggaggcctgtgctttgggatttaagaaaaaaa

SEQ ID NO: 8023 - DNA, 1247 bp, Artificial Sequence
  Synthetic polypeptide
ggccgggcacggtggctcacacctatcatcccagcactttgggaagcaaagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagagactccacaaggcacacagagaaactgtccttccccacactggaggcctgtgctttgggatttaagaaaaaaagaaagaaagaaagaaagaaggtttcagaggata

SEQ ID NO: 8024 - DNA, 857 bp, Artificial Sequence
  Synthetic polypeptide
ggccgggcgcagtggctcacacctgcaatcccagcactttgggaggccgaagcagacagatcacttgaggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtga

SEQ ID NO: 8025 - DNA, 2162 bp, Artificial Sequence
  Synthetic polypeptide
caaaaaaaacccaaaaaaggcaaaggactggaatagacgtttattcaaagaagatgcacaaatggccagtaagcccatgaaaagatgctcaacgtcactaatcataaggtaaatgcaaatcaaaaccacagtgagataccaccgtacacctgttgaggacagcaactatcaaaacagaaaatggcacatatcagtgaggatgcggagaaatgggaacccttgtgcactgctggtaggaagtgaaacggtgcatctgctgtgaaaaactcaaaaaactaagtgtggaactaccatgtgatccagcagttccactgctgggcacgtgccccagcagcactgaaagcagggtcttgaagagatgcttgtacacccacgttgatagcagcatcaaccacagcagccaaaagggggaagccacccgagggtcggctgtcgggcgaacggatcagcaaagtgtcgtgtgcaaaacgcagtgacgtgtgactcagcctgagaagcagcgaagctggggcccgcgctgcagcgtggatgagcctcggggacactgtgccgaatgaacttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcagttctgcaggctgggaagcccaaggtcgaggggctgcctttggtga

SEQ ID NO: 8026 - DNA, 2306 bp, Artificial Sequence
  Synthetic polypeptide
caaaaaaaacccaaaaaaggcaaaggactggaatagacgtttattcaaagaagatgcacaaatggccagtaagcccatgaaaagatgctcaacgtcactaatcataaggtaaatgcaaatcaaaaccacagtgagataccaccgtacacctgttgaggacagcaactatcaaaacagaaaatggcacatatcagtgaggatgcggagaaatgggaacccttgtgcactgctggtaggaagtgaaacggtgcatctgctgtgaaaaactcaaaaaactaagtgtggaactaccatgtgatccagcagttccactgctgggcacgtgccccagcagcactgaaagcagggtcttgaagagatgcttgtacacccacgttgatagcagcatcaaccacagcagccaaaagggggaagccacccgagggtcggctgtcgggcgaacggatcagcaaagtgtcgtgtgcaaaacgcagtgacgtgtgactcagcctgagaagcagcgaagctggggcccgcgctgcagcgtggatgagcctcggggacactgtgccgaatgaacttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaagatacagaaaacttctaaagtttatacggagtctcaagagacccagagaagccaaacaattttgtga

SEQ ID NO: 8027 - DNA, 3632 bp, Artificial Sequence
  Synthetic polypeptide
caaaaaaaacccaaaaaaggcaaaggactggaatagacgtttattcaaagaagatgcacaaatggccagtaagcccatgaaaagatgctcaacgtcactaatcataaggtaaatgcaaatcaaaaccacagtgagataccaccgtacacctgttgaggacagcaactatcaaaacagaaaatggcacatatcagtgaggatgcggagaaatgggaacccttgtgcactgctggtaggaagtgaaacggtgcatctgctgtgaaaaactcaaaaaactaagtgtggaactaccatgtgatccagcagttccactgctgggcacgtgccccagcagcactgaaagcagggtcttgaagagatgcttgtacacccacgttgatagcagcatcaaccacagcagccaaaagggggaagccacccgagggtcggctgtcgggcgaacggatcagcaaagtgtcgtgtgcaaaacgcagtgacgtgtgactcagcctgagaagcagcgaagctggggcccgcgctgcagcgtggatgagcctcggggacactgtgccgaatgaacttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataaggacggggaggtttactgcatcgacgcgcggttctacgggaacgtcagccggttcatcaaccaccactgcgagcccaacctggtgcccgtgcgcgtgttcatggcccaccaggacctgcggttcccccggatcgccttcttcagcacccgcctgatcgaggccggcgagcagctcgggtttgactatggagagcgcttctgggacatcaaaggcaagctcttcagctgccgctgcggctcccccaagtgccggcactcgagcgcggccctggcccagcgtcaggccagcgcggcccaggaggcccaggaggacggcttgcccgacaccagctccgcggctgccgccgaccccctatga

SEQ ID NO: 8028 - DNA, 781 bp, Artificial Sequence
  Synthetic polypeptide
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagaaagacacaccgacctggaccaagggagacaggcataaacagctccaaagggaaacacacgggaaaaagagagaacaagagaaagaaatagacgccctgaaagaagagacagagacttatgagccgtag

SEQ ID NO: 8029 - DNA, 680 bp, Artificial Sequence
  Synthetic polypeptide
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtag

SEQ ID NO: 8030 - DNA, 1156 bp, Artificial Sequence
  Synthetic polypeptide
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttag

SEQ ID NO: 8031 - DNA, 1123 bp, Artificial Sequence
  Synthetic polypeptide
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgaggtgatctggccccgcccccacccgcgatcggccctaaatccctag

SEQ ID NO: 8032 - DNA, 648 bp, Artificial Sequence
  Synthetic polypeptide
tgtggtggttttaaaatacgtctgcaaattcttcaacactttgaaagataaagtctatttccccaatctttgagtgcaggctctccttagcaactggcttccaatgaacataagtaatggtggggaacttcaggactaggtcataaaaagcattgctgtttcttacttgcccattcccttcaactgatttctgtaaaggaagccagtcaccatacggtgaggacactcaagcaatctgtgaagagatccatataagagaagagctgaaatttcctgccagcaaccagcaccaggtgagtgaaccatggtgaagtggatcctccagccgtagttaaatctccagatgactacagccccagccaacatcttgactgcaacctcataaaacactgtgagcagaaatcatccaactaagctgctcccagattcctgacccacaaaaactacagtaggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggc

SEQ ID NO: 8033 - DNA, 678 bp, Artificial Sequence
  Synthetic polypeptide
tgatgtggtttgggtctgtgtccccacccaaatctcatgttcagttataattcccaatattgaggtagggtgtgatgggcctgctccatgggagtacgagtcctagtcaccgtgggggcggtttctcatgaatggtttagcaccatccgctttggtactgtggtctgtggtagtgagttctcttgcgatctggctgtttaaaagtgtgtggcacctcccccttctctttcttgctcctgcttccaccatgtgagactccttgctccccctttgccttctgccatgattggaagcttcctgaggcctccccagaagcagaagctgctgtgcttcctgtacatcctgcagaactatgagccaattaagcctcttttctctataaattactcagtctcagattctggggagcaggtcctggtggatgtggagaccaagagcaataaggagatcatggagcacatcagaaaaatcttggggaagaatgaggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaa

SEQ ID NO: 8034 - DNA, 594 bp, Artificial Sequence
  Synthetic polypeptide
tgatgtggtttgggtctgtgtccccacccaaatctcatgttcagttataattcccaatattgaggtagggtgtgatgggcctgctccatgggagtacgagtcctagtcaccgtgggggcggtttctcatgaatggtttagcaccatccgctttggtactgtggtctgtggtagtgagttctcttgcgatctggctgtttaaaagtgtgtggcacctcccccttctctttcttgctcctgcttccaccatgtgagactccttgctccccctttgccttctgccatgattggaagcttcctgaggcctccccagaagcagaagctgctgtgcttcctgtacatcctgcagaactatgagccaattaagcctcttttctctataaattactcagtctcagattctggggagcaggtcctggtggatgtggagaccaagagcaataaggagatcatggagcacatcagaaaaatcttggggaagaatgagcactacctggcagcaccatctaaacctgtatcatctgctgtggtcccagttactcaggaggctgaggcaggaggatcacttgagcccaggaggttgaggctggagtga

SEQ ID NO: 8035 - DNA, 489 bp, Artificial Sequence
  Synthetic polypeptide
tgatgtggtttgggtctgtgtccccacccaaatctcatgttcagttataattcccaatattgaggtagggtgtgatgggcctgctccatgggagtacgagtcctagtcaccgtgggggcggtttctcatgaatggtttagcaccatccgctttggtactgtggtctgtggtagtgagttctcttgcgatctggctgtttaaaagtgtgtggcacctcccccttctctttcttgctcctgcttccaccatgtgagactccttgctccccctttgccttctgccatgattggaagcttcctgaggcctccccagaagcagaagctgctgtgcttcctgtacatcctgcagaactatgagccaattaagcctcttttctctataaattactcagtctcagattctggggagcaggtcctggtggatgtggagaccaagagcaataaggagatcatggagcacatcagaaaaatcttggggaagaatgagtga

SEQ ID NO: 8036 - DNA, 959 bp, Artificial Sequence
  Synthetic polypeptide
aaaaagcatgggatttggaatttgagacctgactttgaagcccacacagaacacagacaagtcaaccatgctatttgggcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctag

SEQ ID NO: 8037 - DNA, 175 bp, Artificial Sequence
  Synthetic polypeptide
aaaaagcatgggatttggaatttgagacctgactttgaagcccacacagaacacagacaagtcaaccatgctatttgggcaaagacctgaccttgaagatgggaagtgccctcttcgtcaagaaggagctgcagctgcaggcaaatttcttgggcaatgtcaagaggctgtatga

SEQ ID NO: 8038 - DNA, 764 bp, Artificial Sequence
  Synthetic polypeptide
aaaaagcatgggatttggaatttgagacctgactttgaagcccacacagaacacagacaagtcaaccatgctatttgggcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagtgagttga

SEQ ID NO: 8039 - DNA, 355 bp, Artificial Sequence
  Synthetic polypeptide
gcggaaaagcaagtaaccgggaatgaaggaagtgggggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctag

SEQ ID NO: 8040 - DNA, 1631 bp, Artificial Sequence; identical to SEQ ID NO: 7615
  Synthetic polypeptide

SEQ ID NO: 8041 - DNA, 434 bp, Artificial Sequence
  Synthetic polypeptide
gcggaaaagcaagtaaccgggaatgaaggaagtggggtcagtcccaaccctgccacgtgcgggtctcgagacggtggacaagtggctggactccactgggcctgggctgtcactgggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctag

SEQ ID NO: 8042 - DNA, 278 bp, Artificial Sequence
  Synthetic polypeptide
ggccaggcgcggtggcttacgcctgtaatcccagcactttgggaagccgaggcaggtggatcacctgaggtcaggagttcgagaccagtctgaccaataaggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaa

SEQ ID NO: 8043 - DNA, 180 bp, Artificial Sequence
  Synthetic polypeptide
atctgagttcaaacccttgtttttctgctttaaagccatgagatcttgggcaagtcacagccttgatttcttcatccgtaaaagtgtttcattgtactgacaacctcagctggcatcatggaccatgaagaagcaagacgaaaacacacaggagggaaaatcctgggattctttttctag

SEQ ID NO: 8044 - DNA, 100 bp, Artificial Sequence
  Synthetic polypeptide
atctgagttcaaacccttgtttttctgctttaaagccatgagatcttgggcaagtcacagccttgatttcttcatccgtaaaagtgtttcattgtactga

SEQ ID NO: 8045 - DNA, 1267 bp, Artificial Sequence; identical to SEQ ID NO: 463
  Synthetic polypeptide

SEQ ID NO: 8046 - DNA, 249 bp, Artificial Sequence
  Synthetic polypeptide
tgggcctctctggcctatttcccatgatttcctccttctcttgctctgtattccaggggagctgaccccttgggttttccaggctccaggatcagttggtcctcactgtcttcaaccaatgggaggcactgtggaaagactgcaggtgaagcccaagagccaaaggaatcaccaccaccttctaaaacgtcagcagctgctcagttggatgagctcatggctcacctgactgagatgcaggccaagtag

SEQ ID NO: 8047 - DNA, 1089 bp, Artificial Sequence
  Synthetic polypeptide
tgggcctctctggcctatttcccatgatttcctccttctcttgctctgtattccaggggagctgaccccttgggttttccaggctccaggatcagttggtcctcactgtcttcaaccaatgggaggcactgtggaaagactgcaggtgaagcccaagagccaaaggaatcaccaccaccttctaaaacgtcagcagctgctcagttggatgagctcatggctcacctgactgagatgcaggccaaggttgcagtgagagcagatgctggcaagaagcacttaccagacaagcaggatcacaaggcctccctggactcaatgcttgggggtctggagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggcctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaa

SEQ ID NO: 8048 - DNA, 2243 bp, Artificial Sequence
  Synthetic polypeptide
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaa

SEQ ID NO: 8049 - DNA, 1338 bp, Artificial Sequence
  Synthetic polypeptide
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaacccca

SEQ ID NO: 8050 - DNA, 1263 bp, Artificial Sequence
  Synthetic polypeptide
ctctccctctccctgtccctgtccctctccctctccccatggtttccctctccctctctttccacggtctccctctcatgccgagccgaagctggactatactgctgccatctcggctcactgcaacctccctgcctgattctcctgcctcagcctgcggagtgcctgcaattgcaggtgcgcgccgccacgcctgactggttttcgtatttttttggtggagacggggtttcgctgtgatggccaggctggtctccagctcctaaccgcgagtggtccgccagcctcggactcccgaggtgccgggattgcagacggagtctggttctctcagtgctcaatggcgcccaggctggagcgcagtggcgtgatctcggctcgctacaacctccacctcccagccgcctgccttggcctcccaaagtgccgagattgcagcctctgccaggccgccaccccgtctgggaagtgaggagcgtctctgcctggccgcccatcgtctgggacgtgaggagtccctctgcctggctgcccagtctggaaagtgaggagcgtctctgcccagccgccatcccatctcggaagtgaggagcgcctcttcccggccgccatcacatctaggaagtgaggagcgtctctgcccggccgcccatcgtctgggatgtggggagtgcctctgccccgccgccccgtctgggatgtgaggagcgcctctgcccggccgccaccccgtctgggaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctga

SEQ ID NO: 8051 - DNA, 834 bp, Artificial Sequence
  Synthetic polypeptide
gaagccatctgttccccaggaagccttccctgatgtgctgtttggtcgcatcttgtgtatacctacgtatctgcacttatccttctgaacctgctgttgtcctgtcacttgtgtttccttctgtgacttatacgcgtctgcagaacaggaccggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtga

SEQ ID NO: 8052 - DNA, 679 bp, Artificial Sequence
  Synthetic polypeptide
gaagccatctgttccccaggaagccttccctgatgtgctgtttggtcgcatcttgtgtatacctacgtatctgcacttatccttctgaacctgctgttgtcctgtcacttgtgtttccttctgtgacttatacgcgtctgcagaacaggaccggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactggg

SEQ ID NO: 8053 - DNA, 2254 bp, Artificial Sequence
  Synthetic polypeptide
tttatacaactgtagctgatgtgctcttgtaagtgccaactcctggctggaggccagccaatacaaaaccagcgcacttaacaaaaatacaaccaaggaccttcacagaatctacttcacacccctgttacctccaccagagtaagtgctggtatccacgcctgagagacctggagacagatcacatcacaggactctttgcagacactctccagtaccagcttagagcctgattatctccactgggcggctagatcaagaagagaaataacaatcactgcagtttggctctcaggaagccccatccctaggggaaaggggagagcaccacatcaagggagcatccctgtgggacaaaagaatctgaacagcagcccttgagttccagatcttccctctgacatagtctatccagatgagaaggaactggaaaaacaactggggtaatatgacaaaacagggttctttgacactctgaaaaggtcacactagcttaccagcaatggatctaaaccaagacaaaaatctctgaattgccagaaaaagaattcacaaggtcattattacgccaatcaaggaggcacgagagaaaggtgaagtccaacttagcaaaacaaaaaaagtgatacaggatatgaatggaaaaatttccaggaaaatagcataaataaataatcacaacttctgaaaatcaagggacacacttagagacatgcaaaatgcactggaaagtctcagcaatagaattgaataagtagaagaaagaaatttcagagttcgaagacaaggcttttgaattagcccaatctgacaaagacaaaaaagaatttaaaaaaatgaacgcagcctccaataagtttgttaaacaaccaagcctaagaataattggtgttcccaaggaagaagaagaatctaaaagtttggaaaacaaatttgagggattaattgaggaaaacttccccggccttgctagagatctagacatccaaatacaagaagcttaaagaacacctgggaaattcatcacaaaaagatcatcacctaggcacatagtcatcaggttaactaaagtcaagatgaaggaaagaatcttaagagctgtgagtcaaaagcctcaggtaacctataaaggaaaacctatcagattaacagatttctcagcagaaactctaaaagctagaagggattgggatcctatcttgagcctccttaagttatcagccagtaattttgtatccagtgaaacagagcttcataaatgaaggaaagtagtctttttcacacaaacaagtgctgagagaatttgccactaccaagccagcactacaagaactgctaaaaggagctccaaatcttgaaacaaattctcaaaataccaaaattgtatctccttaaagcataaatcacacaggacctataaaacaataacacaatgaagaaaaaaaacaaggtgttcaggcaaacaaatagcacgatgaatagaatagtacctcaaatctcaatactaatgttgaatgtaaatggcctacatgctccactttaaagatacagaatagcagaatggataagaactcatcaaccaagtatctgctgtcttcaagagattcaccagacacaaaaggactcaaatttaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaa

SEQ ID NO: 8054 - DNA, 2044 bp, Artificial Sequence
  Synthetic polypeptide
tttatacaactgtagctgatgtgctcttgtaagtgccaactcctggctggaggccagccaatacaaaaccagcgcacttaacaaaaatacaaccaaggaccttcacagaatctacttcacacccctgttacctccaccagagtaagtgctggtatccacgcctgagagacctggagacagatcacatcacaggactctttgcagacactctccagtaccagcttagagcctgattatctccactgggcggctagatcaagaagagaaataacaatcactgcagtttggctctcaggaagccccatccctaggggaaaggggagagcaccacatcaagggagcatccctgtgggacaaaagaatctgaacagcagcccttgagttccagatcttccctctgacatagtctatccagatgagaaggaactggaaaaacaactggggtaatatgacaaaacagggttctttgacactctgaaaaggtcacactagcttaccagcaatggatctaaaccaagacaaaaatctctgaattgccagaaaaagaattcacaaggtcattattacgccaatcaaggaggcacgagagaaaggtgaagtccaacttagcaaaacaaaaaaagtgatacaggatatgaatggaaaaatttccaggaaaatagcataaataaataatcacaacttctgaaaatcaagggacacacttagagacatgcaaaatgcactggaaagtctcagcaatagaattgaataagtagaagaaagaaatttcagagttcgaagacaaggcttttgaattagcccaatctgacaaagacaaaaaagaatttaaaaaaatgaacgcagcctccaataagtttgttaaacaaccaagcctaagaataattggtgttcccaaggaagaagaagaatctaaaagtttggaaaacaaatttgagggattaattgaggaaaacttccccggccttgctagagatctagacatccaaatacaagaagcttaaagaacacctgggaaattcatcacaaaaagatcatcacctaggcacatagtcatcaggttaactaaagtcaagatgaaggaaagaatcttaagagctgtgagtcaaaagcctcaggtaacctataaaggaaaacctatcagattaacagatttctcagcagaaactctaaaagctagaagggattgggatcctatcttgagcctccttaagttatcagccagtaattttgtatccagtgaaacagagcttcataaatgaaggaaagtagtctttttcacacaaacaagtgctgagagaatttgccactaccaagccagcactacaagaactgctaaaaggagctccaaatcttgaaacaaattctcaaaataccaaaattgtatctccttaaagcataaatcacacaggacctataaaacaataacacaatgaagaaaaaaaacaaggtgttcaggcaaacaaatagcacgatgaatagaatagtacctcaaatctcaatactaatgttgaatgtaaatggcctacatgctccactttaaagatacagaatagcagaatggataagaactcatcaaccaagtatctgctgtcttcaagagattcaccagacacaaaaggactcaaatttaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatttgttagcatcagtgacctcctggtaccaaaagacttgggaacagaaagccagatctttatttcccgcacatatgatgccaccactcattttgagacaacgtgtgatgacattaaaaacatctataagaggatga

SEQ ID NO: 8055 - DNA, 1735 bp, Artificial Sequence
  Synthetic polypeptide
tttatacaactgtagctgatgtgctcttgtaagtgccaactcctggctggaggccagccaatacaaaaccagcgcacttaacaaaaatacaaccaaggaccttcacagaatctacttcacacccctgttacctccaccagagtaagtgctggtatccacgcctgagagacctggagacagatcacatcacaggactctttgcagacactctccagtaccagcttagagcctgattatctccactgggcggctagatcaagaagagaaataacaatcactgcagtttggctctcaggaagccccatccctaggggaaaggggagagcaccacatcaagggagcatccctgtgggacaaaagaatctgaacagcagcccttgagttccagatcttccctctgacatagtctatccagatgagaaggaactggaaaaacaactggggtaatatgacaaaacagggttctttgacactctgaaaaggtcacactagcttaccagcaatggatctaaaccaagacaaaaatctctgaattgccagaaaaagaattcacaaggtcattattacgccaatcaaggaggcacgagagaaaggtgaagtccaacttagcaaaacaaaaaaagtgatacaggatatgaatggaaaaatttccaggaaaatagcataaataaataatcacaacttctgaaaatcaagggacacacttagagacatgcaaaatgcactggaaagtctcagcaatagaattgaataagtagaagaaagaaatttcagagttcgaagacaaggcttttgaattagcccaatctgacaaagacaaaaaagaatttaaaaaaatgaacgcagcctccaataagtttgttaaacaaccaagcctaagaataattggtgttcccaaggaagaagaagaatctaaaagtttggaaaacaaatttgagggattaattgaggaaaacttccccggccttgctagagatctagacatccaaatacaagaagcttaaagaacacctgggaaattcatcacaaaaagatcatcacctaggcacatagtcatcaggttaactaaagtcaagatgaaggaaagaatcttaagagctgtgagtcaaaagcctcaggtaacctataaaggaaaacctatcagattaacagatttctcagcagaaactctaaaagctagaagggattgggatcctatcttgagcctccttaagttatcagccagtaattttgtatccagtgaaacagagcttcataaatgaaggaaagtagtctttttcacacaaacaagtgctgagagaatttgccactaccaagccagcactacaagaactgctaaaaggagctccaaatcttgaaacaaattctcaaaataccaaaattgtatctccttaaagcataaatcacacaggacctataaaacaataacacaatgaagaaaaaaaacaaggtgttcaggcaaacaaatagcacgatgaatagaatagtacctcaaatctcaatactaatgttgaatgtaaatggcctacatgctccactttaaagatacagaatagcagaatggataagaactcatcaaccaagtatctgctgtcttcaagagattcaccagacacaaaaggactcaaatttaaggctaagtgctatttatggaggtacctatatgctgaataaacccattgaagaaatcattgtacagaatggaaaagtaattggtgtaaaatctgaaggagaa

SEQ ID NO: 8056 - DNA, 3021 bp, Artificial Sequence; identical to SEQ ID NO: 449
  Synthetic polypeptide

SEQ ID NO: 8057 - DNA, 3075 bp, Artificial Sequence; identical to SEQ ID NO: 450
  Synthetic polypeptide

SEQ ID NO: 8058 - DNA, 1143 bp, Artificial Sequence; identical to SEQ ID NO: 451
  Synthetic polypeptide

SEQ ID NO: 8059 - DNA, 427 bp, Artificial Sequence; identical to SEQ ID NO: 573
  Synthetic polypeptide

SEQ ID NO: 8060 - DNA, 163 bp, Artificial Sequence; identical to SEQ ID NO: 480
  Synthetic polypeptide

SEQ ID NO: 8061 - DNA, 104 bp, Artificial Sequence; identical to SEQ ID NO: 481
  Synthetic polypeptide

SEQ ID NO: 8062 - DNA, 404 bp, Artificial Sequence; identical to SEQ ID NO: 6813
  Synthetic polypeptide

SEQ ID NO: 8063 - DNA, 417 bp, Artificial Sequence; identical to SEQ ID NO: 6814
  Synthetic polypeptide

SEQ ID NO: 8064 - DNA, 485 bp, Artificial Sequence; identical to SEQ ID NO: 6815
  Synthetic polypeptide

SEQ ID NO: 8065 - DNA, 1745 bp, Artificial Sequence; identical to SEQ ID NO: 6816
  Synthetic polypeptide

SEQ ID NO: 8066 - DNA, 605 bp, Artificial Sequence
  Synthetic polypeptide
ggaggaggcggtggaggaagaggtggcggcggtggcggtggtcgtagcggtggcggaggaggcggacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactga

SEQ ID NO: 8067 - DNA, 372 bp, Artificial Sequence
  Synthetic polypeptide
ggaggaggcggtggaggaagaggtggcggcggtggcggtggtcgtagcggtggcggaggaggcggacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtctt

SEQ ID NO: 8068 - DNA, 422 bp, Artificial Sequence
  Synthetic polypeptide
ggaggaggcggtggaggaagaggtggcggcggtggcggtggtcgtagcggtggcggaggaggcggacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactga

SEQ ID NO: 8069 - DNA, 476 bp, Artificial Sequence
  Synthetic polypeptide
ggaggaggcggtggaggaagaggtggcggcggtggcggtggtcgtagcggtggcggaggaggcggacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagaatgcagtaatagtggccttgtcttcaaaatcatgggatgtagagactgcaacagaattgcttctgagtaactga

SEQ ID NO: 8070 - DNA, 1629 bp, Artificial Sequence
  Synthetic polypeptide
ctcataccttgatagtgatgtaataaattgatacaaacttctaggagaccagtctgaaaatatgcattaaaaagcatcatgttcttttactgcattacttttcttctgtgattttagcctaaagaagtaattcagaagaacacacaatccagtgatgtttgcaacaaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaaccaacaagccaatctgatcccagggttgaacctcagcgcacttggcatcttttcaacaggactgtccgtgctatctccaccagcagggccccgcggagctccccccgctgccccctaccaccccttcactacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtga

SEQ ID NO: 8071 - DNA, 1500 bp, Artificial Sequence
  Synthetic polypeptide
ctcataccttgatagtgatgtaataaattgatacaaacttctaggagaccagtctgaaaatatgcattaaaaagcatcatgttcttttactgcattacttttcttctgtgattttagcctaaagaagtaattcagaagaacacacaatccagtgatgtttgcaacaaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaacacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtga

SEQ ID NO: 8072 - DNA, 1227 bp, Artificial Sequence; identical to SEQ ID NO: 7622
  Synthetic polypeptide

SEQ ID NO: 8073 - DNA, 1554 bp, Artificial Sequence
  Synthetic polypeptide
ttgtctagccttttattgattgaaaaaccttcattagctggtgcttccacattttgtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtag

SEQ ID NO: 8074 - DNA, 853 bp, Artificial Sequence
  Synthetic polypeptide
ggggaggagccaagatggccaaataggaacagctccggtctacagctcccagcgtgagcgacgcagaagacgggtgatttctgcatttccatctgagaccagtgaccttttctatttcatagtaaacaaacttcatgagtacttgccggagtctagggataagaatgcactacaaaatcaaagccaaagggttgatgagctggtggcatgcattgaaattatacagaccctagtattgatgttcagagaaacagaaaccgagtcatcacgcctgaacacattggcagctaagaagggagcactatttaatctcttggtaattttaattagtgagcctcagattccaaaatcttgtcctgtgtttgatatccagttggtggctgattcagctttagtcagaatgtcttttgacgctgagttacagaagcttattctggagtatacaaatactgctacagcacttttatatgagatacttctggtctttcagcagggaaatctcggattgggatccacaaagtttgctattagctggataatgtcctttctacaaagctgtcctcccatcattacttttgtggccagtattgtgaaacaagtggtgaggggtctttcagcttcatttcagctgctaagtccctgccaagcagttctgttgtaccagcaattttacatcctcaagagctgtctgcggcacagcaggactctagctgagtatattaggaataactacagagaagaattcaggtactttattcacatgccagccttgcagaaaaggctcccattgtgttaccccatcactcaacctaccattcaactttttcatgaagttctgaaattggttgaatag

SEQ ID NO: 8075 - DNA, 2254 bp, Artificial Sequence; identical to SEQ ID NO: 8053
  Synthetic polypeptide

SEQ ID NO: 8076 - DNA, 2044 bp, Artificial Sequence; identical to SEQ ID NO: 8054
  Synthetic polypeptide

SEQ ID NO: 8077 - DNA, 1735 bp, Artificial Sequence; identical to SEQ ID NO: 8055
  Synthetic polypeptide

SEQ ID NO: 8078 - DNA, 1154 bp, Artificial Sequence
  Synthetic polypeptide
atttataacaacaaaaaggggaaacaactggaatgtccatcatctgatatgtgataagcaaaatgtggtatatccatacaatggaatattacttggctgtaaaaaggaatgaagtgtttacatttgccacatgatggatgaattttgaaacatttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttag

SEQ ID NO: 8079 - DNA, 534 bp, Artificial Sequence
  Synthetic polypeptide
aaatgtgtacacgtatgtggaacacattaactaaaatggtaacagaatggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataa

SEQ ID NO: 8080 - DNA, 500 bp, Artificial Sequence
  Synthetic polypeptide
aaatgtgtacacgtatgtggaacacattaactaaaatggtaacagaatggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgt

SEQ ID NO: 8081 - DNA, 453 bp, Artificial Sequence
  Synthetic polypeptide
aaatgtgtacacgtatgtggaacacattaactaaaatggtaacagaatggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaaca

SEQ ID NO: 8082 - DNA, 1331 bp, Artificial Sequence; identical to SEQ ID NO: 550
  Synthetic polypeptide

SEQ ID NO: 8083 - DNA, 1028 bp, Artificial Sequence; identical to SEQ ID NO: 551
  Synthetic polypeptide

SEQ ID NO: 8084 - DNA, 1295 bp, Artificial Sequence; identical to SEQ ID NO: 553
  Synthetic polypeptide

SEQ ID NO: 8085 - DNA, 1322 bp, Artificial Sequence; identical to SEQ ID NO: 554
  Synthetic polypeptide

SEQ ID NO: 8086 - DNA, 1013 bp, Artificial Sequence; identical to SEQ ID NO: 555
  Synthetic polypeptide

SEQ ID NO: 8087 - DNA, 1216 bp, Artificial Sequence; identical to SEQ ID NO: 6819
  Synthetic polypeptide

SEQ ID NO: 8088 - DNA, 510 bp, Artificial Sequence; identical to SEQ ID NO: 6820
  Synthetic polypeptide

SEQ ID NO: 8089 - DNA, 1807 bp, Artificial Sequence
  Synthetic polypeptide
cagccttggattcagaagcccggctgcctgctaagctgtgtaattgccagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagcagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataa

SEQ ID NO: 8090 - DNA, 1854 bp, Artificial Sequence; identical to SEQ ID NO: 6613
  Synthetic polypeptide

SEQ ID NO: 8091 - DNA, 1325 bp, Artificial Sequence; identical to SEQ ID NO: 7686
  Synthetic polypeptide

SEQ ID NO: 8092 - DNA, 1691 bp, Artificial Sequence; identical to SEQ ID NO: 7687
  Synthetic polypeptide

SEQ ID NO: 8093 - DNA, 1541 bp, Artificial Sequence; identical to SEQ ID NO: 7688
  Synthetic polypeptide

SEQ ID NO: 8094 - DNA, 414 bp, Artificial Sequence; identical to SEQ ID NO: 6481
  Synthetic polypeptide

SEQ ID NO: 8095 - DNA, 1148 bp, Artificial Sequence; identical to SEQ ID NO: 436
  Synthetic polypeptide

SEQ ID NO: 8096 - DNA, 1452 bp, Artificial Sequence; identical to SEQ ID NO: 7300
  Synthetic polypeptide

SEQ ID NO: 8097 - DNA, 1149 bp, Artificial Sequence; identical to SEQ ID NO: 7301
  Synthetic polypeptide

SEQ ID NO: 8098 - DNA, 1416 bp, Artificial Sequence; identical to SEQ ID NO: 7302
  Synthetic polypeptide

SEQ ID NO: 8099 - DNA, 1443 bp, Artificial Sequence; identical to SEQ ID NO: 7303
  Synthetic polypeptide

SEQ ID NO: 8100 - DNA, 1134 bp, Artificial Sequence; identical to SEQ ID NO: 7304
  Synthetic polypeptide

SEQ ID NO: 8101 - DNA, 1089 bp, Artificial Sequence
  Synthetic polypeptide
gggcgcggggcgcgccgccatgggcctggccgggctgcaggcaggaagatgtccaagccccgcgcggtggaggcggcggcggcggcggcggcggtggcagcgacggccccgggcccggagatggtggagcggaggggcccggggaggccccgcaccgacggggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaa

SEQ ID NO: 8102 - DNA, 299 bp, Artificial Sequence; identical to SEQ ID NO: 485
  Synthetic polypeptide

SEQ ID NO: 8103 - DNA, 1503 bp, Artificial Sequence
  Synthetic polypeptide
cagaccgcctggtaaatcccagctcctgagctgggtgacctggcctgtctacgtaacctctctgaacctcagtgtccttgtccatggaacagaaactagcccctcatccatctgtctctgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtag

SEQ ID NO: 8104 - DNA, 645 bp, Artificial Sequence
  Synthetic polypeptide
cagaccgcctggtaaatcccagctcctgagctgggtgacctggcctgtctacgtaacctctctgaacctcagtgtccttgtccatggaacagaaactagcccctcatccatctgtctctgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagaggtaaccgaaattttattcatctctggcagccccttctgtcttgcttacgatttgtctacaccatgcacttgggagaagcagctgcagcacatttgttcagcaaagagcagcaggtttctttccttcttgctggaaacttttctgttcccctga

SEQ ID NO: 8105 - DNA, 343 bp, Artificial Sequence
  Synthetic polypeptide
cagaccgcctggtaaatcccagctcctgagctgggtgacctggcctgtctacgtaacctctctgaacctcagtgtccttgtccatggaacagaaactagcccctcatccatctgtctctgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaa

SEQ ID NO: 8106 - DNA, 2588 bp, Artificial Sequence; identical to SEQ ID NO: 6741
  Synthetic polypeptide

SEQ ID NO: 8107 - DNA, 1964 bp, Artificial Sequence; identical to SEQ ID NO: 6742
  Synthetic polypeptide

SEQ ID NO: 8108 - DNA, 609 bp, Artificial Sequence
  Synthetic polypeptide
gctgggcaccgtggctcaggcctgtaatcctagcactttgggagactgaagagggcggatcccttgaggtcaggagttcgagaccagccatggtgaaaccctatcccagttacttggggaggctgaggccaaagaatcgcttgaaccgggaggcgaaggatgcaggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaa

SEQ ID NO: 8109 - DNA, 320 bp, Artificial Sequence
  Synthetic polypeptide
gctgggcaccgtggctcaggcctgtaatcctagcactttgggagactgaagagggcggatcccttgaggtcaggagttcgagaccagccatggtgaaaccctatcccagttacttggggaggctgaggccaaagaatcgcttgaaccgggaggcgaaggatgcaggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttacca

SEQ ID NO: 8110 - DNA, 3355 bp, Artificial Sequence
  Synthetic polypeptide
cactctattctgtcatatgactatatgcgtgtggctgactctcccaccaaattgagacatcctcaagccaccatcagagactgatatgatgcctgagggaccatctttccctgtctgtagcacttttgtacaagaactctttcaagcgcaatacagatcttctttgacgtgtcctcattgtcagaaacagagcaacacttttgatcctttcctttgcatttctttgccaattcctctgccccacacaaggcctctctatgtcactgtagtgtatcaaggcaaatgttctcactgcatgaggattggtgtggccgtacctctgtctgggactgtcgccagacttcgggaagcagtgtctatggaaacaaagatccccactgatcagattgtgttaacagaaatgtactatgatgggttccatcgttccttttgtgatacagacgacctggaaacagtccatgaaagcgactgcatttttgcctttgagactcccgaaatatttaggcctgaaggaattctcagtcaaagaggaattcatttaaacaacaacctaaaccacttgaaatttggcttggattatcatagactgtcttctcctacacaaacagcagcaaagcaggggaaaatggattctcccacatcaagagcaggcagcgacaagattgtcctgttggtgtgtaaccgagcctgcactgggcaacaagggaaaagatttggactgccttttgtgctgcacttagagaagacaatagcttgggaccttctgcagaaggaaatcttggagaagatgaagtatttcttgaggcccacggtttgcattcaggtgtgtccattcagcttgcgtgtggtcagtgttgttggaataacatatttgctgccccaggaggagcagcccttgtgccacccaatagtagaaagggcattaaaatcttgtggaccaggtggcactgctcatgtgaaattagtagtcgagtgggacaaggagacaagagatttcttatttgtaaatactgaggatgagtatattcctgatgcagaaagtgttcgtctgcaaagggagcgtcatcatcagcctcaaacctgcactttatcccagtgtttccaactgtacaccaaagaggagcggcttgcccccgatgatgcctggcgttgcccacactgtaagcagctgcagcagggaagcattacgttaagcctctggactctgcctgatgtgcttattatacatctaaagagatttcggcaggaaggagacaggcgcatgaaacttcagaacatggtcaaattccccttgactggcctggacatgacacctcacgtggttaagaggagccagagcagctggagtttgccatcgcattggtccccgtggagacggccctatggactcgggagggaccctgaggactacatctatgacctgtatgctgtgtgcaatcaccatggcaccatgcaaggggggcactacacagcgtactgtaagaactctgtggacggcctctggtactgcttcgatgacagcgatgtgcagcagctgtcagaagatgaggtctgcacgcagacagcatacatcctcttctaccagaggcggacagccatcccgtcatggtcagccaacagctcggtggcaggctccacaagttcttccctgtgtgaacactgggtgagccggctcccgggcagcaagccagccagcgtgacctctgcagcttcctccagacgcacctccctggcgtcgctctctgagtccgtggagatgactggagaaaggagtgaagatgatggaggcttttcaactcgaccatttgtgagaagtgtccagcgtcagagtttgtcatccagatcttctgtcaccagccccttggccgtcaatgaaaattgcatgagaccttcatggtccctgtctgctaagctgcagatgcgctccaattctccatcccgattttcaggggattcgccaattcacagctctgcttccaccttggagaagattggggaggcagcagatgacaaggtctccatctcttgctttggtagcttgcggaacctttctagcagttaccaggaaccaagcgacagtcatagtcgccgtgagcacaaggctgtgggccgggcccctctggctgtcatggaaggcgtgttcaaagacgaatcggacacccgcagattgaactccagtgtcgtagatacacagagcaaacattcagcacaaggggaccgcctgcccccgctctctggtccatttgataacaataatcagatcgcttatgtggatcagagcgactccgtagacagctctccagtcaaagaggtgaaagcccccagccacccaggctcactcgcaaagaaaccagagagcacaactaagagatcccccagttccaaaggcacttctgagccagagaaaagcttgcggaaggggagaccagccttggcaagccaggagtcatccctttcaagtacatccccttcttctcctcttcctgtaaaagtctctctaaagccctcccgctcccgcagcaaagcagattcttcttccaggggcagtggacggcattcatcccctgcccctgcccaacccaaaaaggagtcatccccgaaatctcaggactccgtgtcatctccttcgccacagaagcagaagtcagcctcggccctcacctacactgcttcctccacatctgccaaaaaggcctcgggccctgccacaaggagccctttcccacctgggaagagcaggacttcagaccacagcttgagtagagagggctccagacaaagcttgggttctgacagagccagcgccacctccacctccaaacccaattcccctcgggtgagccaggcccgagcaggggagggcaggggggccgggaagcacgtgcggagctcctccatggccagcctgcgctcccccagcacaagcatcaagtctggtttgaagagggacagcaagtctgaggacaaggggctgtccttcttcaaatcagccttgagacagaaggaaacccggcgctcgacggatcttggcaagacagccttgctctctaaaaaggctggtgggagctctgttaagtctgtctgtaagaacaccggggacgacgaggcagagagaggccaccagcctccagcttcccagcagccaaatgcaaatacaacgggaaaagagcagcttgtcaccaaggaccctgcttctgccaaacattccctgctgtccgctcgcaaatccaagtcttcccaactagactctggagttccctcgtctccgggtggcaggcagtctgcagagaaatcctcaaaaaagttatcttctagcatgcaaacctctgcacggccttctcaaaaacctcagtga

SEQ ID NO: 8111 - DNA, 920 bp, Artificial Sequence
  Synthetic polypeptide
aggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactga

SEQ ID NO: 8112 - DNA, 207 bp, Artificial Sequence; identical to SEQ ID NO: 7693
  Synthetic polypeptide

SEQ ID NO: 8113 - DNA, 268 bp, Artificial Sequence; identical to SEQ ID NO: 7694
  Synthetic polypeptide

SEQ ID NO: 8114 - DNA, 1931 bp, Artificial Sequence; identical to SEQ ID NO: 7491
  Synthetic polypeptide

SEQ ID NO: 8115 - DNA, 1089 bp, Artificial Sequence
  Synthetic polypeptide
ctgttgccgctatgcccacagtagtatttgttacataacaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctga

SEQ ID NO: 8116 - DNA, 483 bp, Artificial Sequence; identical to SEQ ID NO: 7323
  Synthetic polypeptide

SEQ ID NO: 8117 - DNA, 374 bp, Artificial Sequence
  Synthetic polypeptide
gctgctgtggtaagcagtttgatggaccctcaaaaagctaaacagcatttccatgtgacctggcaattcccttcctaggtatacactcaagagaactgaaaacaagtgctcaagcagaaacttgtacatgaatgttcatcccatcattattcacaatagccaaaaaattgaaacagcccaaatgctcatcagccaatgagtggagaaacaaaacatgtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtga

SEQ ID NO: 8118 - DNA, 3238 bp, Artificial Sequence
  Synthetic polypeptide
gcagttctcaaagtgttggtatggacccttgggtgtgagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccacgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatag

SEQ ID NO: 8119 - DNA, 1224 bp, Artificial Sequence; identical to SEQ ID NO: 6690
  Synthetic polypeptide

SEQ ID NO: 8120 - DNA, 873 bp, Artificial Sequence
  Synthetic polypeptide
ggccaggtgaggtggctcacacctgtaatcccagcactttgggaggccaaggcaggcggatcacctgagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagagaacagcacattag

SEQ ID NO: 8121 - DNA, 921 bp, Artificial Sequence
  Synthetic polypeptide
ggccaggtgaggtggctcacacctgtaatcccagcactttgggaggccaaggcaggcggatcacctgagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagaggatcgctgcagagcagagcagtagattggcaaaatataggacactacgaacagcacattag

SEQ ID NO: 8122 - DNA, 2537 bp, Artificial Sequence; identical to SEQ ID NO: 7357
  Synthetic polypeptide

SEQ ID NO: 8123 - DNA, 1913 bp, Artificial Sequence; identical to SEQ ID NO: 7358
  Synthetic polypeptide

SEQ ID NO: 8124 - DNA, 337 bp, Artificial Sequence; identical to SEQ ID NO: 6393
  Synthetic polypeptide

SEQ ID NO: 8125 - DNA, 404 bp, Artificial Sequence; identical to SEQ ID NO: 7701
  Synthetic polypeptide

SEQ ID NO: 8126 - DNA, 336 bp, Artificial Sequence; identical to SEQ ID NO: 7702
  Synthetic polypeptide

SEQ ID NO: 8127 - DNA, 3325 bp, Artificial Sequence; identical to SEQ ID NO: 7703
  Synthetic polypeptide

SEQ ID NO: 8128 - DNA, 169 bp, Artificial Sequence; identical to SEQ ID NO: 7704
  Synthetic polypeptide

SEQ ID NO: 8129 - DNA, 169 bp, Artificial Sequence; identical to SEQ ID NO: 7705
  Synthetic polypeptide

SEQ ID NO: 8130 - DNA, 241 bp, Artificial Sequence; identical to SEQ ID NO: 7706
  Synthetic polypeptide

SEQ ID NO: 8131 - DNA, 273 bp, Artificial Sequence; identical to SEQ ID NO: 7707
  Synthetic polypeptide

SEQ ID NO: 8132 - DNA, 329 bp, Artificial Sequence; identical to SEQ ID NO: 7708
  Synthetic polypeptide

SEQ ID NO: 8133 - DNA, 203 bp, Artificial Sequence; identical to SEQ ID NO: 7709
  Synthetic polypeptide

SEQ ID NO: 8134 - DNA, 271 bp, Artificial Sequence; identical to SEQ ID NO: 7710
  Synthetic polypeptide

SEQ ID NO: 8135 - DNA, 297 bp, Artificial Sequence; identical to SEQ ID NO: 7711
  Synthetic polypeptide

SEQ ID NO: 8136 - DNA, 127 bp, Artificial Sequence; identical to SEQ ID NO: 7712
  Synthetic polypeptide

SEQ ID NO: 8137 - DNA, 289 bp, Artificial Sequence; identical to SEQ ID NO: 7343
  Synthetic polypeptide

SEQ ID NO: 8138 - DNA, 246 bp, Artificial Sequence; identical to SEQ ID NO: 7344
  Synthetic polypeptide

SEQ ID NO: 8139 - DNA, 149 bp, Artificial Sequence; identical to SEQ ID NO: 7345
  Synthetic polypeptide

SEQ ID NO: 8140 - DNA, 89 bp, Artificial Sequence; identical to SEQ ID NO: 7346
  Synthetic polypeptide

SEQ ID NO: 8141 - DNA, 80 bp, Artificial Sequence; identical to SEQ ID NO: 7347
  Synthetic polypeptide

SEQ ID NO: 8142 - DNA, 1101 bp, Artificial Sequence
  Synthetic polypeptide
ggccaggcacggtggctcacgcctgtaatcccggcacttggggaggccaaggcgggcagatcatgagaccggcctggccaacgtagtgaaatctctacataaaattagccaggtttggtggcgggtgcctgaaatcccagctactcgggaggctgaggcaggagaatcacttgaacccaggacatggagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactga

SEQ ID NO: 8143 - DNA, 1896 bp, Artificial Sequence
  Synthetic polypeptide
ggccaggcacggtggctcacgcctgtaatcccggcacttggggaggccaaggcgggcagatcatgagaccggcctggccaacgtagtgaaatctctacataaaattagccaggtttggtggcgggtgcctgaaatcccagctactcgggaggctgaggcaggagaatcacttgaacccaggacatggagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctag

SEQ ID NO: 8144 - DNA, 1662 bp, Artificial Sequence
  Synthetic polypeptide
ggccaggcacggtggctcacgcctgtaatcccggcacttggggaggccaaggcgggcagatcatgagaccggcctggccaacgtagtgaaatctctacataaaattagccaggtttggtggcgggtgcctgaaatcccagctactcgggaggctgaggcaggagaatcacttgaacccaggacatggagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccaggtactttctcagcccagcaggacctgcaagggtaccctgcactgggcctcgggggcagtcctgagccttgaggagctttggaagacctcagcttcctcatcttacctcttgggggctttgaggggattaagagaatcaatgaaaagggcttaa

SEQ ID NO: 8145 - DNA, 161 bp, Artificial Sequence; identical to SEQ ID NO: 7668
  Synthetic polypeptide

SEQ ID NO: 8146 - DNA, 178 bp, Artificial Sequence; identical to SEQ ID NO: 7669
  Synthetic polypeptide

SEQ ID NO: 8147 - DNA, 619 bp, Artificial Sequence
  Synthetic polypeptide
ggccaggcatggtggctcacgcctgtaatcccagcactttgggaggccgaggcgggcggatcacgaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtga

SEQ ID NO: 8148 - DNA, 520 bp, Artificial Sequence; identical to SEQ ID NO: 6424
  Synthetic polypeptide

SEQ ID NO: 8149 - DNA, 740 bp, Artificial Sequence
  Synthetic polypeptide
ttatgaattccattgtgtcctccacccccaaggataggttgggatcctgaacccccatccctcagcatgtgacttcatttagagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataa

SEQ ID NO: 8150 - DNA, 407 bp, Artificial Sequence
  Synthetic polypeptide
ttatgaattccattgtgtcctccacccccaaggataggttgggatcctgaacccccatccctcagcatgtgacttcatttagagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctga

SEQ ID NO: 8151 - DNA, 486 bp, Artificial Sequence; identical to SEQ ID NO: 7296
  Synthetic polypeptide

SEQ ID NO: 8152 - DNA, 2738 bp, Artificial Sequence
  Synthetic polypeptide
tttccacggtctccctctcatgccgagccgaagctggacggtactgctgccatctcggctcactgcaacctccctgcctgattctcctgcctcagcttgccgagtgcctgcgattgcaggtgcacgccgccacgcctgactggttttcgtattttcttggtggagactgggattcgctgtgttggccgggctggtctccagctcctaaccgcgagtgatccgacagcctcggcctcccgaggtgccgggattgcagacggagtctcgttcattcagtgctcaatggtgcccaggctggagtgcagtggcgtgatcttggctcgtgcaacctccacctcccagcagcctgccttggcctcccaaagtgccgagattgcagcctctgcccggccgccaccccgtctgggaagtgaggagcttctccgcctggccgcctatcgtctgggatgtgaggagcccctctgcctggctgcccagtctggaaagtgaggagcgtctctacccggccgccatcccatctaggaagtgaggagcgcctcttcccggccaccatcacatctgggaagtgaggagcgtctctgccctgccgcccatcgtctgagatgtggggagcacctctgccctgccgccccgtccgggatgtgaggagcgtctctgcccggacgccccgtctgagaagtgaggagaccctctgcctggcaaccgccccgtctgagaagtgaggagcccctccgcccggcagccgccccgtctgagaatgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtga

SEQ ID NO: 8153 - DNA, 252 bp, Artificial Sequence
  Synthetic polypeptide
gccaggtgcagtggctcacgcctgtaatccagcactttgggaggcggaggcaggtggatcacgaggtcaggagatcgagaccatcctggctaacacgtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaa

SEQ ID NO: 8154 - DNA, 594 bp, Artificial Sequence; identical to SEQ ID NO: 455
  Synthetic polypeptide

SEQ ID NO: 8155 - DNA, 1031 bp, Artificial Sequence; identical to SEQ ID NO: 456
  Synthetic polypeptide

SEQ ID NO: 8156 - DNA, 643 bp, Artificial Sequence
  Synthetic polypeptide
ggctggtcacggtggctcaagcctgtaatcccagcacttggggaggccgaggccggtggatcacctgaggtcgggagttcgagatcagcctgaccaacatggagaaaccccgtctctactaaaactacaaaaaattagccgggtgtcgtgacgtgtgcctgtaatcccagctactcaggaggctgaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccggatcgctgacaaagcattctaccagcagccagatgctgatatcatcggctacgtggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctag

SEQ ID NO: 8157 - DNA, 589 bp, Artificial Sequence
  Synthetic polypeptide
ggctggtcacggtggctcaagcctgtaatcccagcacttggggaggccgaggccggtggatcacctgaggtcgggagttcgagatcagcctgaccaacatggagaaaccccgtctctactaaaactacaaaaaattagccgggtgtcgtgacgtgtgcctgtaatcccagctactcaggaggctgaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccgggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctag

SEQ ID NO: 8158 - DNA, 301 bp, Artificial Sequence
  Synthetic polypeptide
ggctggtcacggtggctcaagcctgtaatcccagcacttggggaggccgaggccggtggatcacctgaggtcgggagttcgagatcagcctgaccaacatggagaaaccccgtctctactaaaactacaaaaaattagccgggtgtcgtgacgtgtgcctgtaatcccagctactcaggaggctgaggaggccaacggtcctgctgatggctacgcagccattgcccaggctgacaggctgacccaggagcctgagagcatccgcaagtggcgagaggagcagaggaaacggctttcgtga

SEQ ID NO: 8159 - DNA, 895 bp, Artificial Sequence
  Synthetic polypeptide
tggacttccattggtttaattaaaagtagtcaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaa

SEQ ID NO: 8160 - DNA, 1063 bp, Artificial Sequence
  Synthetic polypeptide
tggacttccattggtttaattaaaagtagtcaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaa

SEQ ID NO: 8161 - DNA, 369 bp, Artificial Sequence; identical to SEQ ID NO: 7297
  Synthetic polypeptide

SEQ ID NO: 8162 - DNA, 5196 bp, Artificial Sequence
  Synthetic polypeptide
aatatggaggctttggagtcaggctacccaggttctaatctcagctctgtcacttactgtatgaccttgagcaagttactttattaccatgggttttcagtttccttacctataaaatgagaataataatagtactttaatttataggttaatgctgggggctcagtgagttgctgcatataaagtccctgacaatagtcagggttcaataaaggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtag

SEQ ID NO: 8163 - DNA, 5277 bp, Artificial Sequence
  Synthetic polypeptide
aatatggaggctttggagtcaggctacccaggttctaatctcagctctgtcacttactgtatgaccttgagcaagttactttattaccatgggttttcagtttccttacctataaaatgagaataataatagtactttaatttataggttaatgctgggggctcagtgagttgctgcatataaagtccctgacaatagtcagggttcaataaaggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaagtgtgggaatatggatgactctgttcttcagtgccttttgtctctgctaagctgtctcaacaacctcttcctcttacttaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtag

SEQ ID NO: 8164 - DNA, 3933 bp, Artificial Sequence
  Synthetic polypeptide
aatatggaggctttggagtcaggctacccaggttctaatctcagctctgtcacttactgtatgaccttgagcaagttactttattaccatgggttttcagtttccttacctataaaatgagaataataatagtactttaatttataggttaatgctgggggctcagtgagttgctgcatataaagtccctgacaatagtcagggttcaataaaggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaagtgtgggaatatggatgactctgttcttcagtgccttttgtctctgctaagctgtctcaacaacctcttcctcttacttaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtgaggaggctgctgctggctagctctcggggtatctgctgtctctcatga

SEQ ID NO: 8165 - DNA, 2010 bp, Artificial Sequence
  Synthetic polypeptide
aatatggaggctttggagtcaggctacccaggttctaatctcagctctgtcacttactgtatgaccttgagcaagttactttattaccatgggttttcagtttccttacctataaaatgagaataataatagtactttaatttataggttaatgctgggggctcagtgagttgctgcatataaagtccctgacaatagtcagggttcaataaaggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtaggagctggagctcaggtagtagtgctcactcacctgccactcaccgagccccgctgtccagcccggttcctaacagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaa

SEQ ID NO: 8166 - DNA, 272 bp, Artificial Sequence
  Synthetic polypeptide
ggccgggcgtggtggctcatgcctgtaatcccagcactttgggaggctgagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaa

SEQ ID NO: 8167 - DNA, 89 bp, Artificial Sequence
  Synthetic polypeptide
ggccgggcgtggtggctcatgcctgtaatcccagcactttgggaggctgagaaaagaatgaagcaaatgtcagacagacgcgaaaatga

SEQ ID NO: 8168 - DNA, 223 bp, Artificial Sequence
  Synthetic polypeptide
ggccgggcgtggtggctcatgcctgtaatcccagcactttgggaggctgagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttcc

SEQ ID NO: 8169 - DNA, 2983 bp, Artificial Sequence
  Synthetic polypeptide
gctctcatctgggggcagttgtgtccccaggtggcatctggcaacatctgaagacatttttggctgccacggctgggcagggggtgctgttggcattgagtaggtgagctgctccccggtgtctgcccagctcctgtcggtgctgcagggcctcctgcacctggagcccaccctccgctccagccagctgctctgggaggccctggagagcctcgtgaaccgggccgtgctcctggccagcgatgcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagcccagagccctggagcagcaggcgtccaccccacccccacccccacccccacccctgctccctggttccagtgccgagccccctccccctcccccaccaccccccctgcccagtgtgggggctaaggccctcccaacagcacccccgcccccacccctgccaggcctgggggccatggcccccccagcacctcctctaccaccacccctgccaggctcctgtgagttcctgcccccaccacctccaccactcccgggcttgggatgcccgcccccacccccacccctgctgcctggtatgggctggggccctcctccacccccacctccactactgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaaggcctcaggcccaggcccaaggccaagtga

SEQ ID NO: 8170 - DNA, 3010 bp, Artificial Sequence
  Synthetic polypeptide
gctctcatctgggggcagttgtgtccccaggtggcatctggcaacatctgaagacatttttggctgccacggctgggcagggggtgctgttggcattgagtaggtgagctgctccccggtgtctgcccagctcctgtcggtgctgcagggcctcctgcacctggagcccaccctccgctccagccagctgctctgggaggccctggagagcctcgtgaaccgggccgtgctcctggccagcgatgcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagcccagagccctggagcagcaggcgtccaccccacccccacccccacccccacccctgctccctggttccagtgccgagccccctccccctcccccaccaccccccctgcccagtgtgggggctaaggccctcccaacagcacccccgcccccacccctgccaggcctgggggccatggcccccccagcacctcctctaccaccacccctgccaggctcctgtgagttcctgcccccaccacctccaccactcccgggcttgggatgcccgcccccacccccacccctgctgcctggtatgggctggggccctcctccacccccacctccactactgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaagaggttccccctgattctgatgataataaaacaaagaaactgtgtgtgatccagtaa

SEQ ID NO: 8171 - DNA, 3621 bp, Artificial Sequence
  Synthetic polypeptide
ggccgggcgcagtggctcatgcctgttatcctggcactttgggaggctgaggcgagcagatcacctgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacgggggagctcagtgtgaacactgtcactaccccgaaggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttga

SEQ ID NO: 8172 - DNA, 3312 bp, Artificial Sequence
  Synthetic polypeptide
ggccgggcgcagtggctcatgcctgttatcctggcactttgggaggctgaggcgagcagatcacctgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttga

SEQ ID NO: 8173 - DNA, 2928 bp, Artificial Sequence
  Synthetic polypeptide
ggccgggcgcagtggctcatgcctgttatcctggcactttgggaggctgaggcgagcagatcacctgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatcctgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttga

SEQ ID NO: 8174 - DNA, 3435 bp, Artificial Sequence
  Synthetic polypeptide
ggccgggcgcagtggctcatgcctgttatcctggcactttgggaggctgaggcgagcagatcacctgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttga

SEQ ID NO: 8175 - DNA, 895 bp, Artificial Sequence; identical to SEQ ID NO: 8159
  Synthetic polypeptide

SEQ ID NO: 8176 - DNA, 851 bp, Artificial Sequence
  Synthetic polypeptide
ctccttccacggtctccctctgatgccgagccaaagctggacggtactgctgccatctcggctcactgcaacctccctgcctgattctcctgcctcagcctgccgagtgcctgcgcacgccgccacgcctgactggttttcgttttttttttttggtggagacggggttttgctgtgttggccgggctggtctccagctcctgaccgcgagtgatccgccggcctcggcctcccgaggtgccgggattgcggacggagtctcgttcactcggtgctcggtggtgcccaggctggagtgcagtggcgtgatctcggctcgctacaacctccacctcccagccgcctgccttggccccccaaagtgccgagattgcagcctctgcccggccgccaccccgtctgggaagtgaggagcgtctctgcctggccccccatcgtctgggatatgaggagcctctctgcctggctgcccagtctggagggtgaggagcgtctctgcccggccgccatcccatctaggaggcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagtgtctctgcccggccgccccgtctgagagacatgtagactgccaaagtgtatgggatgctttcaagggtgcatttatttcaaaacatccttgcaacattactgaagaagactatcagccactaatgaagttgggaactcagaccgtaccttgcaacaagaaataa

SEQ ID NO: 8177 - DNA, 1385 bp, Artificial Sequence
  Synthetic polypeptide
ctccttccacggtctccctctgatgccgagccaaagctggacggtactgctgccatctcggctcactgcaacctccctgcctgattctcctgcctcagcctgccgagtgcctgcgcacgccgccacgcctgactggttttcgttttttttttttggtggagacggggttttgctgtgttggccgggctggtctccagctcctgaccgcgagtgatccgccggcctcggcctcccgaggtgccgggattgcggacggagtctcgttcactcggtgctcggtggtgcccaggctggagtgcagtggcgtgatctcggctcgctacaacctccacctcccagccgcctgccttggccccccaaagtgccgagattgcagcctctgcccggccgccaccccgtctgggaagtgaggagcgtctctgcctggccccccatcgtctgggatatgaggagcctctctgcctggctgcccagtctggagggtgaggagcgtctctgcccggccgccatcccatctaggaggcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagtgtctctgcccggccgccccgtctgagagacatgtagactgccaaagtgtatgggatgctttcaagggtgcatttatttcaaaacatccttgcaacattactgaagaagactatcagccactaatgaagttgggaactcagaccgtaccttgcaacaagattcttctttggagcagaataaaagatctggcccatcagttcacacaggtccagcgggacatgttcaccctggaggacacgctgctaggctaccttgctgatgacctcacatggtgtggtgaattcaacacttccaaaataaactatcaatcttgcccagactggagaaaggactgcagcaacaaccctgtttcagtattctggaaaacggtttcccgcaggtttgcagaagctgcctgtgatgtggtccatgtgatgctcaatggatcccgcagtaaaatctttgacaaaaacagcacttttgggagtgtggaagtccataatttgcaaccagagaaggttcagacactagaggcctgggtgatacatggtggaagagaagattccagagacttatgccaggatcccaccataaaagagctggaatcgattataagcaaaaggaatattcaattttcctgcaagaatatctacagacctgacaagtttcttcagtgtgtgaaaaatcctgaggattcatcttgcacatctgagatctga

SEQ ID NO: 8178 - DNA, 483 bp, Artificial Sequence; identical to SEQ ID NO: 7330
  Synthetic polypeptide

SEQ ID NO: 8179 - DNA, 742 bp, Artificial Sequence
  Synthetic polypeptide
tggtgctcagctttgggcacatgtcagaatctagggaagttcttcaggatcccagcatcccagcgacatctggctggaggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataa

SEQ ID NO: 8180 - DNA, 430 bp, Artificial Sequence
  Synthetic polypeptide
tggtgctcagctttgggcacatgtcagaatctagggaagttcttcaggatcccagcatcccagcgacatctggctggaggctttaaggagttttaagctgagtgtcactgtagaccccaaataccatcccaagattatcgggagaaagggggcagtaattacccaaatccggttggagcatgacgtgaacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataa

SEQ ID NO: 8181 - DNA, 383 bp, Artificial Sequence
  Synthetic polypeptide
taggttagtggactaatgagttatcataggagtgggactagcggctttataagaagaggaagagagacctgagctagcaggttagcatgctcagccccctggccacgtgatgccttgcaccacctcaggactctgttgaaagtacccagcagcaaagaaggttctcaccagatgcagctccttgatcttggccttctcagcctccattaactgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatag

SEQ ID NO: 8182 - DNA, 558 bp, Artificial Sequence
  Synthetic polypeptide
caggttttcccatcagcatttcactgaagctgctctttctaagttataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaa

SEQ ID NO: 8183 - DNA, 1793 bp, Artificial Sequence
  Synthetic polypeptide
caggttttcccatcagcatttcactgaagctgctctttctaagttataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggggcttgtaggatatataattccgtattttttggaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaatttggacatgcaagacaatgctgctgccaactaa

SEQ ID NO: 8184 - DNA, 1931 bp, Artificial Sequence
  Synthetic polypeptide
caggttttcccatcagcatttcactgaagctgctctttctaagttataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggggcttgtaggatatataattccgtattttttgggattgttcaacctgaattgaaagcacttgcaatcggcttccattcaatgattatgcgatcgctaggaggtattctagttccaatatattttggggctctgattgatacaacgtgtatgaagtggtccaccaacagctgtggagcacgaggggcttgtaggatatataattccacatatttgggaagagccttcttcggcttgaaggtagccctaatatttccagtacttgttttacttactgtatttatttttgttgtaaggaaaaaatcccatggaaaggataccaaagtattagaaaatgaaagacaagtaatggatgaagcaaacttagaattcttaaacgacagtgaacattttgtaccttctgctgaagaacagtaa

SEQ ID NO: 8185 - DNA, 116 bp, Artificial Sequence
  Synthetic polypeptide
tttttaagaatatgaattaattgtcaaagtttaaacatggagagacttcacataatgatttggatttctggtttctttcaaaaactttggaccagagaagctctcgcatcccgtga

SEQ ID NO: 8186 - DNA, 105 bp, Artificial Sequence
  Synthetic polypeptide
tttttaagaatatgaattaattgtcaaagtttaaacatggagagacttcacataatgatttggatttctggtttctttcaaaaactttggaccagagaagctctc

SEQ ID NO: 8187 - DNA, 738 bp, Artificial Sequence
  Synthetic polypeptide
tgttcagtagcacaatagggtgaccgtagttaataatttgttgtgtttcaaatagccagaagagaagatttggaatatcccagcacaaaggaatgagccgtgtttgaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactga

SEQ ID NO: 8188 - DNA, 807 bp, Artificial Sequence
  Synthetic polypeptide
tgttcagtagcacaatagggtgaccgtagttaataatttgttgtgtttcaaatagccagaagagaagatttggaatatcccagcacaaaggaatgagccgtgtttgaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccgaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactga

SEQ ID NO: 8189 - DNA, 867 bp, Artificial Sequence
  Synthetic polypeptide
tgttcagtagcacaatagggtgaccgtagttaataatttgttgtgtttcaaatagccagaagagaagatttggaatatcccagcacaaaggaatgagccgtgtttgaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccgaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagaggagtatccatgggaaccaagcccctcctgactgccatctggcacaagtgcaggcgtttggaggcagtggatgtgtgctgggaagccgctctgtgtga

SEQ ID NO: 8190 - DNA, 2578 bp, Artificial Sequence; identical to SEQ ID NO: 7194
  Synthetic polypeptide

SEQ ID NO: 8191 - DNA, 2305 bp, Artificial Sequence; identical to SEQ ID NO: 7195
  Synthetic polypeptide

SEQ ID NO: 8192 - DNA, 1759 bp, Artificial Sequence; identical to SEQ ID NO: 7196
  Synthetic polypeptide

SEQ ID NO: 8193 - DNA, 340 bp, Artificial Sequence
  Synthetic polypeptide
cagctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataa

SEQ ID NO: 8194 - DNA, 1019 bp, Artificial Sequence
  Synthetic polypeptide
gtctacttgcttttctaattgtgggtcctaagaccctcatttcaaaaggggtcccatcacataccctggaggaaggaatgttgcacggaggacggtaagaagccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtag

SEQ ID NO: 8195 - DNA, 962 bp, Artificial Sequence
  Synthetic polypeptide
gtctacttgcttttctaattgtgggtcctaagaccctcatttcaaaaggggtcccatcacataccctggaggaaggaatgttgcacggaggacggtaagaagccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaagcccaagccagtgacctggaaaaaatccacctggatgagaagtctttccgttggttgcacaacgaggaccagatggctgtggagaagctctctgacgggatccgcaagtttgccgctgatgcagtga

SEQ ID NO: 8196 - DNA, 287 bp, Artificial Sequence
  Synthetic polypeptide
gtctacttgcttttctaattgtgggtcctaagaccctcatttcaaaaggggtcccatcacataccctggaggaaggaatgttgcacggaggacggtaagaagccatcgacgagtacaagccccaggatgctaccaccaacccgtccctgatcctggccgcagcacagatgcccgcttaccaggagctggtggaggaggcgattgcctatggccggaagctgggcggaaatactaaagaagattccgggccgagtatccacagaagtagacgcaaggctctcctttga

SEQ ID NO: 8197 - DNA, 186 bp, Artificial Sequence; identical to SEQ ID NO: 7638
  Synthetic polypeptide

SEQ ID NO: 8198 - DNA, 366 bp, Artificial Sequence; identical to SEQ ID NO: 7663
  Synthetic polypeptide

SEQ ID NO: 8199 - DNA, 3401 bp, Artificial Sequence
  Synthetic polypeptide
ccttgctactcaaagtgtggtccacgggccagcagcatcagccacacctgggagtgtgttataaaagcaggatcccagccctagctcagatctgctgagtcagaagctgcagttcaacaagcttcctaggagacctgaagactgtgtccacaaagggcaagaccaccactgcagatatccacagctacggcagcagtggtggtggtggcagtggaggaggtggcggtgttggtggcgctggcggcggcccttggggaccagcgccagcctggtgcccctgcggctcctgctgcagctggtggaagtggctgctgggcctgctgctcacctggctgctactcctggggctgctcttcggcctcattgctctggcggaggaggtgaggaagctgaaggcgcgtgtggatgagctggagaggatcaggaggagcatactgccctatggggacagcatggatagaatagaaaaggaccgcctccagggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtgacatgggaagtccaggccctaaaggagatcgagggttccctgggactccaggtatccctgggcccttgggccacccaggtccacaaggaccaaagggtcaaaaaggcagcgtgggagatcctggcatggaaggccccatgggccagagagggcgagaaggccccatgggacctcgtggtgaggcagggcctcctggatctggagagaaaggggaaagaggggctgctggtgaaccaggtcctcatggcccacctggtgtcccaggttctgtgggtcccaaaggttccagcggctctcctggcccacagggccctccaggtcctgtaggtctccaagggctccgaggtgaagtaggacttcctggtgtcaaaggtgacaaaggaccaatgggaccaccaggacccaaaggtgaccagggtgagaaaggacctcgaggcctcacaggcgagcctggcatgagaggtttgcctggtgctgttggtgagcccggggctaaaggagcaatgggtcctgctggcccagacggacaccaaggcccaagaggtgaacaaggtcttactgggatgcctggaatccgtggcccaccaggaccttctggagacccaggaaagccaggtctcacaggaccccagggacctcagggacttcccggtacccctggccgaccaggaataaaaggtgaaccaggagctccaggcaagatcgtgacttcggaggggtcatcgatgctcactgtcccaggccccccaggacctcctggagccatgggacccccaggacctccaggtgccccaggccctgccggcccagctggtctcccaggacatcaagaagttcttaatttacaaggtcccccaggcccacccggcccacgcgggccaccagggccttccattccaggcccaccaggaccccgaggcccaccaggggagggtttgccaggcccaccaggcccaccaggatcgttcctgtccaactcagaaaccttcctctccggccccccaggcccacctggccccccaggtcccaagggagaccaaggtcccccaggccccagaggacaccaaggcgagcaaggcctcccaggtttctcaacctcagggtccagttctttcggactcaaccttcagggaccaccaggcccacctggcccccagggacccaaaggtgacaaaggtgatccaggtgttccaggggctcttggcattcctagtggtccttctgaagggggatcatcaagtaccatgtacgtgtcaggcccgccagggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggacttcggggtacggtgtcagcttgttctcgtcctccatctcttctgaagacattctggctgtgctgcagcgggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctgggatcagcattgggcttcctggtcccccggggccccctggcttgccgggaacctcctatgaggagctcctctccttgctgcgagggtctgaattcagaggcatcgttggacccccaggtcccccgggtccaccagggatcccaggcaatgtgtggtccagcatcagcgtggaggacctctcgtcttacttacatactgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtga

SEQ ID NO: 8200 - DNA, 3155 bp, Artificial Sequence
  Synthetic polypeptide
ccttgctactcaaagtgtggtccacgggccagcagcatcagccacacctgggagtgtgttataaaagcaggatcccagccctagctcagatctgctgagtcagaagctgcagttcaacaagcttcctaggagacctgaagactgtgtccacaaagggcaagaccaccactgcagatatccacagctacggcagcagtggtggtggtggcagtggaggaggtggcggtgttggtggcgctggcggcggcccttggggaccagcgccagcctggtgcccctgcggctcctgctgcagctggtggaagtggctgctgggcctgctgctcacctggctgctactcctggggctgctcttcggcctcattgctctggcggaggaggtgaggaagctgaaggcgcgtgtggatgagctggagaggatcaggaggagcatactgccctatggggacagcatggatagaatagaaaaggaccgcctccagggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtgacatgggaagtccaggccctaaaggagatcgagggttccctgggactccaggtatccctgggcccttgggccacccaggtccacaaggaccaaagggtcaaaaaggcagcgtgggagatcctggcatggaaggccccatgggccagagagggcgagaaggccccatgggacctcgtggtgaggcagggcctcctggatctggagagaaaggggaaagaggggctgctggtgaaccaggtcctcatggcccacctggtgtcccaggttctgtgggtcccaaaggttccagcggctctcctggcccacagggccctccaggtcctgtaggtctccaagggctccgaggtgaagtaggacttcctggtgtcaaaggtgacaaaggaccaatgggaccaccaggacccaaaggtgaccagggtgagaaaggacctcgaggcctcacaggcgagcctggcatgagaggtttgcctggtgctgttggtgagcccggggctaaaggagcaatgggtcctgctggcccagacggacaccaaggcccaagaggtgaacaaggtcttactgggatgcctggaatccgtggcccaccaggaccttctggagacccaggaaagccaggtctcacaggaccccagggacctcagggacttcccggtacccctggccgaccaggaataaaaggtgaaccaggagctccaggcaagatcgtgacttcggaggggtcatcgatgctcactgtcccaggccccccaggacctcctggagccatgggacccccaggacctccaggtgccccaggccctgccggcccagctggtctcccaggacatcaagaagttcttaatttacaaggtcccccaggcccacccggcccacgcgggccaccagggccttccattccaggcccaccaggaccccgaggcccaccaggggagggtttgccaggcccaccaggcccaccaggatcgttcctgtccaactcagaaaccttcctctccggccccccaggcccacctggccccccaggtcccaagggagaccaaggtgatccaggtgttccaggggctcttggcattcctagtggtccttctgaagggggatcatcaagtaccatgtacgtgtcaggcccgccagggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggacttcggggtacggtgtcagcttgttctcgtcctccatctcttctgaagacattctggctgtgctgcagcgggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctgggatcagcattgggcttcctggtcccccggggccccctggcttgccgggaacctcctatgaggagctcctctccttgctgcgagctgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtga

SEQ ID NO: 8201 - DNA, 4686 bp, Artificial Sequence
  Synthetic polypeptide
gttgaagaaaggaaaccttttgatcatctcattagatgccaagaaggttacaccggatgacatcaattgaaagagaagaaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccaccacgggaggcacactggttacatctatgactgtgagcaaagagtattccacacgagacaaagtgaaactgatgaaattttcaagaccaaagaagactcgttcaggtacagctctgccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaac

SEQ ID NO: 8202 - DNA, 6266 bp, Artificial Sequence
  Synthetic polypeptide
gttgaagaaaggaaaccttttgatcatctcattagatgccaagaaggttacaccggatgacatcaattgaaagagaagaaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccaccacgggaggcacactggttacatctatgactgtgagcaaagagtattccacacgagacaaagtgaaactgatgaaattttcaagaccaaagaagactcgttcaggtacagctctgccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtacagtcttcaactcaaactctttcatcaggacaaactttaaatcaagttactgtttcatccccatcccgtcctcagctacaaatacagcagccacagccccaagtcattgctgtgcctcagctgcaacaacaagtccaggttctctctcagatccagtcacaggttgtggctcagatacaggctcagcaaagtggtgtgccccagcaaatcaaactccagttacctatccaaattcagcaaagcagtgctgtgcagactcaccagattcagaatgtggttacagtgcaggcagccagtgtgcaagagcagttgcaaagggttcagcaactcagggatcagcagcaaaagaagaaacagcaacagatagaaattaagcgtgaacacaccctccaagcttctaatcaaagtgaaatcattcagaaacaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaa

SEQ ID NO: 8203 - DNA, 5837 bp, Artificial Sequence
  Synthetic polypeptide
gttgaagaaaggaaaccttttgatcatctcattagatgccaagaaggttacaccggatgacatcaattgaaagagaagaaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccaccacgggaggcacactggttacatctatgactgtgagcaaagagtattccacacgagacaaagtgaaactgatgaaattttcaagaccaaagaagactcgttcaggtacagctctgccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaa

SEQ ID NO: 8204 - DNA, 171 bp, Artificial Sequence; identical to SEQ ID NO: 6873
  Synthetic polypeptide

SEQ ID NO: 8205 - DNA, 633 bp, Artificial Sequence; identical to SEQ ID NO: 6874
  Synthetic polypeptide

SEQ ID NO: 8206 - DNA, 636 bp, Artificial Sequence; identical to SEQ ID NO: 6875
  Synthetic polypeptide

SEQ ID NO: 8207 - DNA, 480 bp, Artificial Sequence; identical to SEQ ID NO: 6876
  Synthetic polypeptide

SEQ ID NO: 8208 - DNA, 1138 bp, Artificial Sequence; identical to SEQ ID NO: 7655
  Synthetic polypeptide

SEQ ID NO: 8209 - DNA, 1164 bp, Artificial Sequence
  Synthetic polypeptide
ctccagagccagcctgcctgggtttaaatcatggctttactgcttctctgggatcttagaaagctgcttatcctctctgagcctcagtttctgcatctgttaaatagagacaatggaaggacctccctcttagtgttgcggatattggagagctgattgatgctagaacacttccaagcacgtgtgttggtcacatggcagggcatgaccattcggcccctggtagacctgttggctgtgaagaaaaagcaagagacgaagcgctccatcaacgaagagatccacacacagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaagagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcagtgacccaggcccacaccctgagcctggggagggagaaccgttcttccccaaggggcagtaa

SEQ ID NO: 8210 - DNA, 761 bp, Artificial Sequence
  Synthetic polypeptide
ttgcccctgcctggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaa

SEQ ID NO: 8211 - DNA, 797 bp, Artificial Sequence
  Synthetic polypeptide
ttgcccctgcctggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaa

SEQ ID NO: 8212 - DNA, 881 bp, Artificial Sequence
  Synthetic polypeptide
ttgcccctgcctggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagtgtttagaatctccagtggggaagaggaaaagaagcatgactgttagtacttctcaggacccatctttctcaggattaaaccagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaa

SEQ ID NO: 8213 - DNA, 543 bp, Artificial Sequence; identical to SEQ ID NO: 6496
  Synthetic polypeptide

SEQ ID NO: 8214 - DNA, 378 bp, Artificial Sequence; identical to SEQ ID NO: 6497
  Synthetic polypeptide

SEQ ID NO: 8215 - DNA, 267 bp, Artificial Sequence; identical to SEQ ID NO: 6498
  Synthetic polypeptide

SEQ ID NO: 8216 - DNA, 416 bp, Artificial Sequence; identical to SEQ ID NO: 6499
  Synthetic polypeptide

SEQ ID NO: 8217 - DNA, 162 bp, Artificial Sequence; identical to SEQ ID NO: 6500
  Synthetic polypeptide

SEQ ID NO: 8218 - DNA, 320 bp, Artificial Sequence
  Synthetic polypeptide
aatataaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggatttgaacttctcgaagagctaccaacacccaagttcagctttggaggcagatctggaaacagtgtagcagcattggttttccaaaaaatgtga

SEQ ID NO: 8219 - DNA, 485 bp, Artificial Sequence
  Synthetic polypeptide
aatataaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttag

SEQ ID NO: 8220 - DNA, 252 bp, Artificial Sequence; identical to SEQ ID NO: 7309
  Synthetic polypeptide

SEQ ID NO: 8221 - DNA, 554 bp, Artificial Sequence
  Synthetic polypeptide
ccactggagggcaagtggaggaagcccgcatccattacaacataggagccgtaggttagatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgagtccccgctgagactgagcagacgcctccaggatctgtcggcagctgctgttctgagggagagcagagaccatgtctga

SEQ ID NO: 8222 - DNA, 482 bp, Artificial Sequence
  Synthetic polypeptide
ccactggagggcaagtggaggaagcccgcatccattacaacataggagccgtaggttagatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtga

SEQ ID NO: 8223 - DNA, 5464 bp, Artificial Sequence; identical to SEQ ID NO: 7409
  Synthetic polypeptide

SEQ ID NO: 8224 - DNA, 4444 bp, Artificial Sequence; identical to SEQ ID NO: 7410
  Synthetic polypeptide

SEQ ID NO: 8225 - DNA, 574 bp, Artificial Sequence; identical to SEQ ID NO: 7411
  Synthetic polypeptide

SEQ ID NO: 8226 - DNA, 1746 bp, Artificial Sequence
  Synthetic polypeptide
gaaaaaagaaaggctcactggagcactttggattccgtattttcagatttggggtgctaaactgcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatag

SEQ ID NO: 8227 - DNA, 1749 bp, Artificial Sequence
  Synthetic polypeptide
gaaaaaagaaaggctcactggagcactttggattccgtattttcagatttggggtgctaaactgcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatag

SEQ ID NO: 8228 - DNA, 519 bp, Artificial Sequence
  Synthetic polypeptide
gaaaaaagaaaggctcactggagcactttggattccgtattttcagatttggggtgctaaactgcggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctc

SEQ ID NO: 8229 - DNA, 507 bp, Artificial Sequence
  Synthetic polypeptide
ctccccagcacttggtgcctgcctctagcatagcacttaacccttcttactgtcattacttatctccatgtctgtctccccctagagtgtgagctcctcgagggcaggaaccctgtttttattcatctttgtgtcccggtgccaagcacagtgcctggctcatggaatcacccttcggtcatcgtgcagcctgggaagagacctttacctgtggaatccccggatactcaaaggaagcggaggatacacagatgtgattatgatggatgcaacaaagtgtacactaaaagctcccacttgaaagcacacagaagaacacacacaggagaaaaaccctacaaatgtacatgggaagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctga

SEQ ID NO: 8230 - DNA, 1133 bp, Artificial Sequence; identical to SEQ ID NO: 7332
  Synthetic polypeptide

SEQ ID NO: 8231 - DNA, 1172 bp, Artificial Sequence; identical to SEQ ID NO: 7333
  Synthetic polypeptide

SEQ ID NO: 8232 - DNA, 1188 bp, Artificial Sequence
  Synthetic polypeptide
tgtaaaggctaattttaggtgtacacttgactgcattaagtaatatccagagagccggtaaagcattatttctgggtctatgagggcgattttggaaaagattgacatttgagccagcagactacgtaaggaagatccactctcactgaatgtgagcgagcaccatccaatcagctgagggcccagatagaacaaaaaggcagaagaaaatcagattcactctctctcttctggagctgaaacaactttcttttcctgccataggacatcaggaccccaggttctctggtcttgggactctgagacttgcaccaggaatcctgcccaggctctcaggcctttggactcagactgagctacttcactggctttcctggttctccagcttgaagatggcagatcgtgggacttctcagcctccataattgagtgagccaattccctggccaaaaggtgtgttttgctgacttcaagcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataa

SEQ ID NO: 8233 - DNA, 2672 bp, Artificial Sequence; identical to SEQ ID NO: 6621
  Synthetic polypeptide

SEQ ID NO: 8234 - DNA, 1767 bp, Artificial Sequence; identical to SEQ ID NO: 6622
  Synthetic polypeptide

SEQ ID NO: 8235 - DNA, 1692 bp, Artificial Sequence; identical to SEQ ID NO: 6623
  Synthetic polypeptide

SEQ ID NO: 8236 - DNA, 1052 bp, Artificial Sequence; identical to SEQ ID NO: 447
  Synthetic polypeptide

SEQ ID NO: 8237 - DNA, 1118 bp, Artificial Sequence; identical to SEQ ID NO: 448
  Synthetic polypeptide

SEQ ID NO: 8238 - DNA, 2297 bp, Artificial Sequence; identical to SEQ ID NO: 7386
  Synthetic polypeptide

SEQ ID NO: 8239 - DNA, 2447 bp, Artificial Sequence; identical to SEQ ID NO: 7387
  Synthetic polypeptide

SEQ ID NO: 8240 - DNA, 2312 bp, Artificial Sequence; identical to SEQ ID NO: 7388
  Synthetic polypeptide

SEQ ID NO: 8241 - DNA, 2375 bp, Artificial Sequence; identical to SEQ ID NO: 7389
  Synthetic polypeptide

SEQ ID NO: 8242 - DNA, 2093 bp, Artificial Sequence; identical to SEQ ID NO: 7390
  Synthetic polypeptide

SEQ ID NO: 8243 - DNA, 2090 bp, Artificial Sequence; identical to SEQ ID NO: 7391
  Synthetic polypeptide

SEQ ID NO: 8244 - DNA, 433 bp, Artificial Sequence
  Synthetic polypeptide
cttcaggtgccaaaagtcactttctgccagtccacctccaacttcagccacagctgctgtggactctctggacagctcagagcctcctggtgcaacatggccccgcccaaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctga

SEQ ID NO: 8245 - DNA, 433 bp, Artificial Sequence
  Synthetic polypeptide
cttcaggtgccaaaagtcactttctgccagtccacctccaacttcagccacagctgctgtggactctctggacagctcagagcctcctggtgcaacatggccccgcccaaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcggtaatggccagtctggatga

SEQ ID NO: 8246 - DNA, 1411 bp, Artificial Sequence
  Synthetic polypeptide
gactgacaggagtgtggaatggtgcatcggaagacttagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtga

SEQ ID NO: 8247 - DNA, 886 bp, Artificial Sequence
  Synthetic polypeptide
gggcgcggggcgcgccgccatgggcctggccgggctgcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaa

SEQ ID NO: 8248 - DNA, 225 bp, Artificial Sequence
  Synthetic polypeptide
gggcgcggggcgcgccgccatgggcctggccgggctgcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctga

SEQ ID NO: 8249 - DNA, 751 bp, Artificial Sequence
  Synthetic polypeptide
gggcgcggggcgcgccgccatgggcctggccgggctgcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaa

SEQ ID NO: 8250 - DNA, 1197 bp, Artificial Sequence
  Synthetic polypeptide
ggctaaggaaaagagcactgggctgagactcaggagacctggtttctagccccagctgtacctctaattgtaaccttgggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaa

SEQ ID NO: 8251 - DNA, 199 bp, Artificial Sequence
  Synthetic polypeptide
ggctaaggaaaagagcactgggctgagactcaggagacctggtttctagccccagctgtacctctaattgtaaccttgggagatacaactcgtcaacgaatcaaattcagtgatgacagagtatgcaagagtcaccttctcaactgttgtcctcatgatgtcctttctggaactagaatggatcttggagaatgtctga

SEQ ID NO: 8252 - DNA, 1365 bp, Artificial Sequence
  Synthetic polypeptide
tggcaaataggtttcatcatttgtttcagcttagatttgttgacagcggtttcctggagtgctgtcttgagaacgattctgaggaggctcagcaagaaagagtgtttcagttgattggctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtag

SEQ ID NO: 8253 - DNA, 2147 bp, Artificial Sequence
  Synthetic polypeptide
ggacggggagggacgaggaggaatggggcgagatggggagggacggagtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctag

SEQ ID NO: 8254 - DNA, 148 bp, Artificial Sequence; identical to SEQ ID NO: 6388
  Synthetic polypeptide

SEQ ID NO: 8255 - DNA, 1100 bp, Artificial Sequence; identical to SEQ ID NO: 6389
  Synthetic polypeptide

SEQ ID NO: 8256 - DNA, 464 bp, Artificial Sequence; identical to SEQ ID NO: 6390
  Synthetic polypeptide

SEQ ID NO: 8257 - DNA, 280 bp, Artificial Sequence; identical to SEQ ID NO: 6391
  Synthetic polypeptide

SEQ ID NO: 8258 - DNA, 294 bp, Artificial Sequence
  Synthetic polypeptide
attagccaggcatggtggcacacacctgtggtctcagctactcaggaggctgaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtga

SEQ ID NO: 8259 - DNA, 2132 bp, Artificial Sequence
  Synthetic polypeptide
aagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttag

SEQ ID NO: 8260 - DNA, 2183 bp, Artificial Sequence
  Synthetic polypeptide
aagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatgtaagtatttttataggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttag
